United States Patent 12,661,367 (STREPTOMYCES SPORORAVEUS STRAIN AND A NEW ANTIBIOTICS AGAINST BACTERIA AND FUNGI) - sequence listing, part 3

SEQ ID NO: 3 - DNA, 7201269 bp, Streptomyces sp. (residues 1,800,319-3,600,636 of 7,201,269)
  source 1..7201269: mol_type = genomic DNA
gggagtcgatgaagtcggcgagggaggcgttggcgaacttgtggcgggcgaagtgggtgttgatgccggccaggaagtccttctcgccgagccaggcgacgagttggcgcagggcggaggcgcccttggcgtaggagatgccgtcgaagttgaggagggcggaggcggtgtcggggacgtcctcgggggtgggggcgacggggtgcgtggaggggcgctggtcggcgtcgtagccccagggcttgcgggtgacgccgaagtcggtccaggtgtcggtgaagcgggtggcttcggtgagggtctggtagcccatgtactcggcgaaggattcgttgagccagatgtcgtcgaaccaggcgagggtgacgaggtcgccgaaccacatgtgggccatctcgtgggcgatgaccatggcgcgggactggcgttcggtgtcggtgacggcggagcggaagatgaactcgtcgcggaaggtgacgagtccggggttctccatggcgccggcgttgaactcgggtacgaaggcctggtcgtaggagtcgaaggggtagggctcggtgaacttctcctggtaccggtcgaagcagtccttggtgatggagaggatttcctcggcgtcgacgtccatgtggggggcgagggactggcggcagtggatgccgaagggcagtccggcgtgttcggtgcggatgctgtgccaggggccggcggcgacggcggcgaggtaggtggagatgaggggggtgggggcggactgccagatggcggcgccgctgccgtcgggggccgcgccggtgcgggtggtgatgccgttggcgaggacggtccagtgggcgggggccgtgacggtgaattcgaagacggccttgaggtcgggctggtcgaaggccgggaagacccgctggacgtcgtccatgaacatctggctgtagacgtacgtctgtccgtcggcggggtcggtgaagcggtgcaggccctcgccggtgcgggagtagcgcatgcgggtgtcgaggtgcagctcgtgggggccttcggtgaggccggtgagcggcagccggtcgtcggcgagggaggccgggtcgagggggttgccgtcgagggtggccgagcgcagctcgacgggcttcagctcgatgaaggtgtctgcggcggtgcgggccgtgaaccggacgacggtggtcgagtcgaaggtttcgtcgtcgtcgccggtgaggtcgagggtcacggcgtagtgctggacgtcgatgagctgggctcggagttgcgcttcgttgcgcgtgagtgcggacatggggcccatgctgccgcagtgggcggccggaccccgagcttctactcttcgcccgcagcgatcgtctcgtggtggcggatgacctcggcgatgatgaagttgaggagcttctcggcgaaggcggggtcgagtttggcgttctcggcgagctggcgcaggcgggcgatctggctggcttcgcggcccgggtcggcggggggcagctggtggcgggccttgaggtggccgacctgctgggtgcacttgaagcgttcggcgagcatgtggacgacggcggcgtcgatgttgtcgatgctgtcgcggaggcgggcgagttcggcggtgacgctctcgtcgatgcctgcggcgtcgtcggccgcgccggtgccggtgccgttgccggtgccgttgtcgaggtcgctgatgttcatggttcccgagaatacgtggcggtggccgtcggttcctcgggcagtcgtcctgtgagacggcacccctgtacttgccggattggaaagtactcgccatagtggaaatcgaccggggaaggtcatccgtgtgcgagcgagggggaaccatgcaggagacggcgaaggcggtcggggcgttggggcgggcggccggtctggagcgggcggcgcggcagcgcagtggctggtacgcgcgctacctgtgggcgttcgcggccgggcagctggtgctcgtgccgatcgccgtgctgtggcacgggccggtctcggcggtggtgttcgcggtgaccaacgcgctgctggtgaccggactgagcgtgtacgcggcgcggcagcgcgtgatgcggcgggggttcggtgtgaagcacggggtgatgatggggtcctgggcgacggtgttcgccctgacgatcacggtcggcacggcggtgttcggccacggggtgccgttcgcggcggtgggcgcgctggcgtgtgcgctggcgccggccgtcggcgcctggaccgagatgcggggtgcggtatgacggacgagccggccgagggcggcggggcgcgggcgaagcggggcgggcatccgcggcacgacctcgcgccgctgctgaacgcgcccgtacggctgtcggtggtggcggcgctggctccgctggacaaggccgagttcgctttcgtacgggacctggtcgaggtctcggactcggtgctgtccaagcaggtggcggcgctggaggaggcgggctgggtggaggtccgcaagggccgggtcgggcggcgtccgcgcacctgggtcgcgctgacctccgagggccgggcggtctaccagcggcatctggcggcgctgcgggccatcgcgctgggctaggccgtgtccgcggggcctgcggccgcggtacggcggggtgtgcgggtccggggtcgcggcgcgggcggactgcgccggagccttccggggctccgccccgggccccgcgcctcgaacgccggcggggccgcaaaggccgggcagccgtgcagcggggtgccgcgcccttccggccggtgcgtggccggccggaagggcgggcgggacgagcgggggggagctacatgcctgccgcggcgctcttgatcgcggcggcgaaggtggagacctcggtgtagacgccggggtagttcggccgggcgcagccttcgccccagctgactatgccgacctggatccaggcgttgttgttgtcgcggcggaacatggggccgccggagtcgccctggcaggtgtcgacgccgccctggggcaggccggcgcagatctcctcgccggggacgaggtcgctgccgtacgagctctggcagctggcgtcggagacgaaggggacgttggccttcaggaggtagcgctgctggccgccgccttcgcgggcggctccccagcctgcgacggtgaaggtgccgttgtcgtaggccttggtgtcggcgatcttgagggtgggcaggttgatgggcttggcgagcttgatgagggcccagtccttgcccttgccgttgtagccgggggcctggaggaccttggtggacttgaccttgatggcgctggagctgttgaggtcgacgactccggcggtggcggtgatggaggtgttgttgccggagccgctcacacagtgggcggcggtgaggacgatctgctgggtgtacagggcgccgccgcagcccatggagaggcgcaccatgaacgggaactcgccctgggcggcgcgcgttccgccgacgacgggggccgggccggcggaggcggtgccgggctggaggctgacggcggcgagggcgaccgcgccgacggcgagggtgcgcttcatcaactgcacaagggtggtcacagtcaacacactgcctttcgtggggggttgggctgtgcgtgcgcgtcatcgggtgaatgacgggtccatgacacaacaggcgtgtggcggacatcaagaaggcagtttcggccaactcccgccccagcggaagagattgcggtaaggagggctcgatgacgcagaacagagcacggagcggtcccgtcgagcacggatttccgcatctggccaccgtgcgtgcctcgatcaccgcgctcttccgccggctgtcggccgacggcatccacgcctacgacacgagcctcgcccccgccgacgccgccttcggcgccaccgacgacctccacctgggcgcgcagcgggtggcggccgcgacggtacgggcgctgcggctgcccgacgcgcgcatggtggtctccttccgcgcgatggagcaggccgccaccgtggagctgaccgcggggcccgagtacttcgtcgaggtcagcgaccgcttccgcacgcaccgccgcgacctcgccgccgccctcgcgcacgaggcggcgcacgtcctgctgcaccgcctggacctgcgtttccccggcaccgccgagaacgagatcctcaccgacaccgcggccgcgtacctgggtgcgggttggctgctcctggacgcctaccgggaggacgcgctgacccaccagaggttcggctacctcacgccggaggaattcggctacgtcctcgccaagcgcgccgcgctgttcggcgaggaccccgccacctggttcaccagcccccaggcgtacgaggcgtacgtacgcgggcgggcgcgggccgagcgcgaccaccgccgggccccgctggcggccgccgggccgctggagcggcggcggtacgcgagggcgcggcgcggcggggccggtccggccggcggctccgcgtaccgcttcgaacaggcggaggacggcggcgggttgcgggtgagcttcccgtgcccggtgtgcgcgcagcggcttcgggtgccggtgcgcgggcggctgcgggcccggtgcgggctgtgccacacggtcctcgactgcctcacgtagatccattcatcacgcggtcacgaaaagtttcctaccggccagtagacaggggttcgattctcgccaactctggtcacgtacatgccaactcgtgaccgaggagcgccccccatgcgcagcacccgccgcacccgtatgccccgtaccgccgccgccggcgtggccgcggccgccgccgtcctgacgctggttccggccaccgccgcccaggccgcgcccgtcccggcgcccgcgcccgtgtccgcgcccgtgtccgccgccccggccgcctccgcgcccggcggcaacgccgcgatcctcggcatcgactacgccacctggcagcgggacgtcgccgccgtgatcgacgcggcccggcccgccatcgaggcgcgcatcgccgcatcgcccgccggcgagaagcccgccctcgtcctcgacatcgacaacacctcgctggagacggacttccactggttctggaccttcccgacccccgcgatcgccaaggtccgcgcgctgacccagtacgcgcaggagcgcggcgtcgcgatcttcttcgtgaccgcccgccccgggatcatccactccctcaccgagcgcaacctgaaggccgtgggctacccggtctcggggctctacgtccgcgatctgccggacctgttcgaggaggtcagcgcctacaagacgggcaagcgggcggagatcgaggcgcgcggctacacgatcatcgccaacatcggcaacagtgcgaccgacctcgtcggcggtcacgcggagcgcaccgtcaagctgccggactacaacggcaagctctcctgaccgtctcccggccttctcctgaccggggtccgcggcccgggacgggccggccgggcggggtccacccggccccaggatccgcggcccgcggtctcggagcgggaaatggacaacatgatgggctgattgcggttcagcgggtggatggagcgggtagtcataggtcaccgcaccggtgaagactcgggcccgacccctcgccagggggccgggcccgcttccgtgccgcgtcctggcgcagttccatgccgccgcggagtcccggctcacctgcggggacgactcccccggctacgccgcggcgtccggcccgtccagcaggttcagctgccaggagacgccgaagcggtcgttcacccagccgaaccgggcgctgaacccgtacgagcccagcggcatcagctccgtgccctgctcggcgagggctccgtagaggcgttcgatctcggcctcgccgtcgcactggacgtagagcgacacggcgggcgtgaagccgaactcgtgcttgaccgagctgtcgatgcacatgagggtctgcccggccagggagaaggaggcgtgccgcaccttcccctcctccccgcccccggcgtcgtccgcgccgtagcggctgatgcccagcacctcggcgtcgtcgaacagcgagaggtagaaggtcatcgcctcctccgcccgcccctcgaacatcagaaacgtggtgatcttctgcgggctcggtgtgatggccatcgccggctcctgtcccttcgttctccggtcctcccggaccacagaaccctatggggcgggacaccggccccggcttaccgcgcgccgtacacggggagcggagcctgcgccgccgcgagcagtttcgcggcggcctcccccgcctccgccggggtccagcgcgcgccccggtccgccgtggggcccggccgccagccctccatgaccgtgatccggccgccctccgcctcgaacacccggccagtgacccccgccgaggcgtccgcgcccagccacaccaccagcggggagacgttctccggggccatcgcgtcgaagccgcccgccccgggggcggccatggtctcggcgaaggtccgttccgtcatccgggtccgcgccgccggggcgatggcgttgacctggaccccgtaggggcccatctcctgcgcggcgaccgccgtgaggccgaggatcccggccttggccgcgctgtagttgccctgtccgaccgagcccagcagtccggccccggaggaggtgttgaccacccgggccgccaccggccggcccgccttcgcctccgcccgccaccacgcggccgccgaccgcagcggcaggaagtggcccttcaggtggacccgcatcaccgcgtcccagtcgtcctcgtccaggttgaccagcatccggtcccgcaggaagcccgcgttgttgacgagggtgtcgaggcggccgaaggtgtccacggccgccgccaccagcgaggccgcgcccccggaggtggcgatgtccccgccgtgcgcgacggcctgcccgcccagtgccgcgatctcggccaccacctgtgccgccgggccgtccggccccggcagcccgtcgagcccgaccccgaggtcgttcacgacgaccttcgccccctccgccgcgaaggccagcgcgtgggcgcgccccagcccccgccccgcgcccgtcacgatcacgacccggccctcgcacagtcccgccatctcagttctccttgttgacagttgccgcatccaagaacggcgggcgctccccgcccccgtgcacgagcaggctcgccccgctcacgtacgccgcccggtccgaggccaggaacaccgcggccgcgcccacgtccgagggttccgcgagccgccccagcgggacggtggcgccgaccgacgcgatgccggtctcgtcgccgtagtgcaggtgggcgagttcggtccgcaccatgccgagcaccagtgagttgacccgtacctcgggcgcccattccacggccatggaccgggccaggttctccagccccgccttggcggcgccgtacgcggccgtccccggtgaggggcgggtcccgctgacgctgccgatcatgaccaccgagccccgggcctcgcgcagccaggggcgggccgcgagcgaggcggtcatcggggcgagcaggttgagctcgacgacccgcgcgtggcgctgcgcctcgccctctcccagcagccggtacggggtgccgcccgcgttgttgaccaggcagtcgaggcgcccgtaccggcccgcgaccgcgccgaagaactcgtgcacggcggcgggatcgcgcaggtcgaccggggtgaaggcggccgtccgcccgtccgccgtcaccggttcctccgggggccgccgggcgcagacgaccacgtccgcgcctgcggcgaggaacgaccgggcgatcccggcgccgacgccccgggttcctccggtgacgacgacaaccctcccgtcgagctccatgggctgctaccttcctcgcctaacaaatgtttggtggaaaggtagctgatccgctcatgggtgtctccaccgcaagccccgacaagggcatcgcactcgtcacagtcgacttcccgcccgtcaacgcgctccccgtgcagggctggtacgacctcgccgacgccctgcgcgccgccggccgcgaccccgagatccggtgcgtcgtcctcgccgccgagggccgcggcttcaacgcgggcgtcgacatcaaggagatgcagcgcgacaccgggcactccgccctcgtcggcgccaaccggggctgctacgaggccttcgccgccgtgtacgagtgcgaggtaccggtcgtcgcggccgtgcacgggttctgcctgggcggcggcatcgggctggtcggcaacgccgacgcgatcgtcgcctccgaggacgccgccttcggactgcccgagctggaccggggcgcgctcggcgccgccacccacctggcccggctggtcccgcagcacctgatgcgcgcgctgtactacacctcgcgcaccgcgaccgccgccgaactgcacgcccacggctcggtctggagggtggtcccgcgtacggagctgcgcgccgccgccctggaactggcagccgagatcgcgaagaaggacggctacctgatccggctcgccaaggcggccatcaacgggatcgaccccgtggacgtacgccgcagctaccgcttcgagcagggcttcaccttcgaggccaacctcagcggggtggccgaccgggtccgcgacaccttcgggaaggaagagcgcgcatgaccgacaggacggacaggacggacaaggtactgacccccgaagaggtggtcggacagctgcacagcggcatgaccatcggcatcggcggctggggatcgcggcgcaagcccatggccctggtgcgcgcactgctccgctccgggatcaccgatctcaccgtgatctcctacggcggccccgacgtcggcctgctggccgccgccggccggatccgcagactcgtcgcccccttcgccaccctcgactccatcccgctggagccgcacttccgggccgcccgcgaacgcgccgccttcactctcaccgagtacgacgaggccatgttcatgtggggcctgcacgccgccgccaaccggctgcccttcctccccgtccgcgccggactcggctccgacgtgatgcgggtcaacccggagctgcgtaccgtcacgtccccctacgacgacggcgaggaactcgtcgccgtccccgccctgcgcatggacgccgccctggtccacctcaaccgcgccgactgcctcggcaacgcccagtacctgggcccggacccgtacttcgacgacctcttctgcgaggccgccgacgccgcctacgtctcctgcgagcagctcgtcgagaccgccgagctcgcgaaggccgggcccccgcagtccctcctcgtcagccggcactccgtgaccggggtcgtggagacccccaacggcgcgcacttcacctcctgcgtccccgactacgaccgcgacgaggcgttccagaagctgtacgcggccaccccctgggacgagttctcggcccgcttcctgtccggggtgggcgagcacgactaccagctggccgtccggacctggcacgaggagcagcagtgacgaccaccgacaccaccgccccgcgcaccgtctcccgcgccgagtactgcgtgatcgcctgcgccgaggcctggcgcgacaacggcgaggtgctcgccagcccgatgggcctgatcccctccttcggggcccgtctcgcgaagcggaccttctcccccgatctgctgctgaccgacggcgaggcgatgctcgtcgggctcgacggcacggccgagggctggctcccgtaccggcgccacctgacgatggtcaccggcggccggcggcacgtgatgatgggcgccagccagatcgaccggttcggcaaccagaacatctcgtgcatcggcgactgggagcggccggcccgccagctcctcggggtgcgcggcgcgcccgtgaacaccctgaacaatccggtgagttactgggtgcccaagcactcgaagcgggtgttcgtcgagcgcgtcgacatggtcagcggggtcggctacgaccgcgcggaggcggccggggtgacccgcttccaccggttgccccgggtggtcagcgatctcggggtcttcgacttcgccgggcccggccacgtgatgcgcctggcttcgctgcaccccggcgtcaccgtcgaggacgtcctggcggcgaccggcttcgagccggcgatcaccggcgaggtcccgttcacccgcgagccgacggccggggaactgcggctgatccgcgaggtgatcgaccccaaggggctgcgcgaccgcgaagtgcgggtctgaggcgatgacgatggcgatggcgacgacgaccacggcgacagcgacgacggcgatgaggcggccatgacgatgcggacggcgttcaccgagttggtcggggtcgagcaccccctcgtgcagacgggcatgggctgggtcgccggcccccgcctggtgtcgggggcggcgaacgcgggggcgctggggatcctggcctcggccacgatgaccctggaccagctgcgtgcggcggtccgcgaggtcaggtcccgcacgccggacgggacccccttcggggtcaatctgcgggcggacgccggggacgcggccgagcgcgcccagctgatcatcgacgagggggtgcgggtcgcctcgttcgcgctggccccctccagggagctgatcgggcggctcaaggacgcgggcgtggtcgtcatcccgtcgatcggggcccggcggcacgccgagaaggtggccgcgtggggcgccgacgcggtgatcgtgcagggcggcgagggcggcgggcacaccggggacgtggccacgacggtgctgctgccgcaggtcgtggacgccgtggacatcccggtgatcgcggcgggcggcttcagcgacgggcgcggcctggtcgcggcgctgtcgtacggggccgcgggcatcgccatgggcacccggttcctgctgacctcggactcgaccgtcccggacgccgtgaaggccgagtacctgagggccacggtcaaggacgtcaccgtcaccacggccgtcgacgggctgccgcaccgcatgctccgtacggagctggtcgactccctggagcgggcgggccgcacccgggcgctggtcagggcggtgcggcacgcggccggcttccggaagctgtccgggctgagctggccgcagatggtccgcgacggcctcgcgatgaaacacggcaaggacctgtcctggagccaggtcctgctcgccgcgaacaccccgatgctcctcaaggcgtccatggtcgagggccgtacggacctcggtgtcatggcatcgggccaggtcgcgggggtgatcgacgatcttccgtcctgtgcggagctcgtctcccgcgtcatggccgaagcacagaaggcactcgcatcactcgaagcactgcactcgctccgcaccctgccaccaccagggtgatcccccttctccgtcacaggagtcgcccctatgagccgtgcccgcatccgcctggtgaccgcggcggccgccgccgctctcaccgtcgggaccctgcccgccgccgcgtacgcggcggcggcgcccggagccggggtcagtgcccggcaccaccagcagcagcagcaagccgaaacgatgcgccagatccctctccagggcgccgtcaatctccgggacgtcggcggctaccgcacctggaccggaggccaggtccgccagggcctcgtctaccgctccgacgcactgagcaagctgaccgatgccgacgtcaccaccgtctccggtctcggcctcacgaaggtcgtcgatttccgcattccgatggagctccagtacgacggcgccgaccggctgcccaccggactctcccccacctcgcgccccgtcagtgacctcggcctctacggaaccctcgtcggcgcgatcggcagcggcgatcccgtggtccaggagcagatgctcggcggcggccgggccgaggcctacatgcgcgacatctaccgcaccttcgtgagcagccccgagaaccgggcgcagttcgcggcgaccctgcgggagatcgccgacgcccggcagggcccggtcctgtaccactgcacgtccggcaaggaccgtaccggctggatgagttacgtcctgctgcgcgccctcgccgtgcccgaggacaccgcggagcgcgactacctggcgtcgaacaccttccgtgccgcctacgacgcccgggtgcgggcgggcctcaagcagtcgggccggatgcagaacccggacctgctgatcccgctccaggaggtccgccaggactacctggacgcggcgacggcacagctggaggccgactacggcggcttctacggctatctgacgcagggcctcagcctcgatctgcggacgctcgcgaagctgcaggaccggatggtccggtagcggacagcacgatgccgggcggcgcttcccgcgccgcccggcatcgtcgtgttcgtgtccggggtgggtcagaccgcccggcgccggccctggccgccggagccgacccggctgcgcgcggaggccgcggcggcgccgccaccgccgccaccggtcccgcgccgggagcgctcgccggagccggccgtcgccccgccgccaccctggccgccgcgacgggcctggcccgcaccggaggccgccggggcctgcccggaggcacccccgccggaacggcggccgcggccgccggccgcgggagcgccggccgtggcggcaccggtgcgcgggccgccgccggagcggcggcgcgagccggagcccgaaccggagccggagcgcggcttgggcgcggtcggctgcgggacctccagcaccaccgggatgcccgagggctccttggcgccggtcagccgggccagttcctcgtcggaggacttgatctgcgcggtgcgcggggagatcccggcgtccgacatcaggcgggtcatgtcccgcttctggtcgggaagcaccagggtgaccacgctgccggactcaccggcacgggcggtacggccgccgcggtgcaggtagtccttgtggtcggtgggcgggtccacgttgacgacgaggtcgaggtcgtcgatgtggatgccgcgcgccgcgacgttggtggcgaccagcgccgtgacctcgcccgtcttgaaccagtcgagggtgcggttgcgctgcggctgggagcggccgccgtgcaggccggaggcgcgtacgccgtcggcgaggagcttcttgaccatgcggtcgaccccgcgcttggtgtcgacgaacatgatcacccggccgtcgcgagcggctatacgcgtcgccacggccttcttgtcggtctcgtccatgacgtacaggacgtggtgctccatggtggtgaccgcaccggccgacgggtcgacggagtggccgaccgggtcggtgaggaacatcttgacgagcttgtcgatgttcttgtccagcgtcgccgagaacagcatccgctggccgccggcctcgacctgcttgagcagtgccgtgacctgcggcatgaagcccatgtcggtcatctggtcggcctcgtcgaggacggtgatcgagacctgggagaggtcggcgtcaccgcggtcgatgaggtccttcaggcggccgggggtggcgacgagcacctcggcgccgcggcgcagggcgcccgactgccggttgatcgacatgccgccgacgacggtcgcgatgcgcaggttgacggccgtggcgtagggggccagggcgtcggtgacctgctgtgcgagctcacgggtcggtacgaggaccagcgcgagcggcgccttcggctccgcgcggcggccggcggtacgggccagcagcgccaggccgaaggccagcgtcttgccggagccggtacggccgcggccgagcaggtcacggccggcgagggagttcggcagcgtcgcggcctggatcgggaacggctcggtgacgccctgggcggcgagggtcttcagcagcgcctcgggcatgtccatgtccccgaacgactcgaccggcggcagcgccgggtcgatcggctcgggcatggtgaattcctggggccgggcaacgggcgcggacttctgccgtcccgcgccagacttcggacgcccctgggccgcacctcgaccccgggtggggcggcggctgggtcgtgcggagctggagctggtcatgcgagaaagccctcctgaaaccggcaggtaaaacaaaggtcgaaacagcagacaagccggggcccgcacctcgcggtgcggaccccggcatgctgaagaacttaggcggggatgatgttctccgcctgggggcccttctggccctgggtgacgtcgaaggacacgcgctggccctcctggagctcacggaagccctgggtggcgatgttcgagtagtgggcgaagacgtccgggccgccaccgtcctgctcgatgaagccgaagcccttttccgagttgaaccacttcacggtgccaagtgccattttaaatctcctgaataggcggcaaagggccccatccggagattccggcaaaacaataaaagcgcctgcggagcattcccgtcaggcgcacataaagttcatgggtaccacaactgcaacgagctctaagctagcacacctcgctgcggggagtcccgggacgaggggtgtgacctgcgccctccgccccgccggcccgcggctcgccggtggcgcggcggaccggcccgtggggccggagcccccgtgccccttgggtcgtgggcggtccgccccttccccgcgatcgccgggggcccggcggcccgcctccgccgtcggcgaaaagattcatccgtacgggtcggaccgatcaggcccgcccgggaggccgctacgggcggcggaagtccctggcggccgcccgccccagctggtttgatcaaggaatggcagcgatcaaggagccctgggggctcagtgtgctcggcgcgggcagcgtgtccgccgaaccccggctcgcccacgtggacctggcggtcgaccttctcgccccgaccccgaaggcggccttcgccgaggcgggcgcggccgtgacccggctgcggagcgtactgcgcgagcacggcatacccgactccgacgtgtccggctcacggctgcagctcacctcgcagtaccggggctacggcgccgaccggaccttccacggctacgcctgcgtggccacgtacaccgtgcggacggaggcgctggccgggctggagctgctgatcgaggacgcggtcacggccggtgcgaaccgggtcgacgccgtgcggttcgaggtggacgacaagcccgccatgcgggacgaggcccggcaccgggcggtggcggccgcccggcgcaaggccgaggtgtacgcgcaggcgtgcggactgcggctggggccggtcatccacatcgaggacgtcgacccggagtcgctggacgtccgcagccacggccggcgcacgggcggtgacccggaggacgacggctccctcaccccgggctcggtccgcgtggaggccgccgtgctcctcggcttcgccctgctccccgagtgacccgtacggcggctacagccgttcgatgatcgtcacgttggcctggccgccgccctcgcacatcgtctggaggccgtagcggccgccggtgcgctccagttcgtgcaggagggtggtcatcagcttcaccccggtcgcgcccagcgggtggccgagggcgatcgcgccgccgttgacgttgacccgctccgggtcggcgccggtctccttcagccaggccagcaccaccggggcgaacgcctcgttgatctccaccaggtcgatgtcggccagcgacatgcccgtcttcttcagcgcgtaggccgtggccgggatcggcgcggacagcatgcggatggggtcctcgccccggaccgacaggtggtggacgcgggcgcgcgggcgcaggccgtgttcccgtaccgcgcgttcggaggcgatcagcatcgccgccgccccgtccgagacctgggaggagacggccgccgtgatggtgccgccctcgaccaccggcttgagggtggccatcttctccaggctcgtgtcccggcgcgggccctcgtccacgcccacgtccccgtacgcgaccgtctcgcgcgcgaagcggccctcgtcgatggcccggaccgcccgccggtgggaccgcagggcgaactcctccatgtcctgccgggtgatcccccacttccgcgcgatcagctgcgcgccgtggaactggttcaccggggcgtccccgtaccgggcccgccagcccgccgagcccgcgtacgggccctcggtcaggcccagcggttccgccgcctgccgggaggcgaaggcgatcgggatcatggacatgttctgggtgccgcccgcgaccaccaggtcctgggtgccggacagcacgccctgcgccgcgaagtgcacggcctgctgcgaggacccgcactggcggtcgacggtgaccccgggcacctcctcgggcaggccggccgccagccaggccgtccgggcgatgtccccggcctgcggccccaccgtgtcgaggcagccgaacaccacgtcctccacggcggccgggtccaccccggaccgctggatcagtgccttcaggacgtgtgcgcccaggtcggccgggtggacggcggccaggccgccgttccgccgccccacgggggtgcgtaccgcatcgactatgtaggcctcgggcatcggatctcctcagacggtggggtctctcacgtggggcgcagtgcgatcccgtccagcaccatcgacaggtactggcgggcgatctcctcggggctgtgctgtccgcccggccggtaccaggaggccgccacccacaccgtgtcgcgcacgaagcggtaggtgaggcggatgtcgaggtcggcgcggaaggccttggcggcgaccccgcgctccagcgtccccagccaggccttctcgaacttctgctgcgagtcggagaggtagtggaagcggggctgggcggagagggtgcgggactccttctggtagatggcgacggcggcgcggtgccggtcgatctcccggaaggactcggtgacgagggcctcgatggtctccctggggccgagaccggcggcgaggacggtgtcgtacccctcccacagttcggtcaggaaggcggagaggatctcgtcgagcatcgattccttggaatcgaagtggtagtagaggctgccggcgagcatgccggcggcgtcggcgatcttgcggacggtggtggcgttgtaaccctgcgcggcgaagacctcggcggcggtgtcgaggagttcacgacgccgttcgggggacgccgtcacctgtggcttcttcttggctgtcggcttgttcgttggcacgcgtccattctcggccagggcatcggcaggacacccgtcaggcgtgctggctgctgacggacaccgtctcgccggtcatgtacgacgagtaggcgctgaccaggaagacgatgacgttggcgacctcccagggttcggcgtaccggccgaaggcctcgcgggcggtcagttcggccaggagctcctcgctggtgaccttcaccaggtgcgggtgcatggccaggctcggggcgaccgcgttgacgcgtacgccgaactcggcggcctccagggccgcgcagcgggtcagggccatcactccggccttggcggcggcgtagtgggcctggccggtctgggcgcgccagccgatgacggaggcgttgttgacgatcactccgccgccgccggacgccctgaacgagcgcagggcggcgcgggtgcagcggaaggtgccgttcagggtgacgtcgaggacgcgggaccactgcgcgtcggtcatgtcggcgagggcggcggtgccgccgaggccggcgttgttgacgacgatgtcgaggcggccgtgggtctgctcggcgcgtgcgaagagggcctggacctggtcctcgtcggtgacgtcgcagggcagggaggtgacgcggtcggcgccgaactcggcggcgagcgcctcctcggtctccttcaggcggcgggcgtgggcgtcgccgatgacgatgcgggcgccctcctccaggaggcggcgggcggtggctccgccgatgccggccccggcggcggcggtgacgacggcggtgcgttccttcagcagtccgtgtccggggacatagccgggggtgttcacgcccgtacctccttgggaaggccgaggacccgctcggcgacgagggtgcgccggatcccggccgagcccgcgcggccgggtccgccgcggcccttgtgggcggcgaacccgccggcgaggtgggtccgtagccacccccggaccccggtgcggaacttctcgacgctgctcatggccgtacgttaacctaccaaacacttgttagggaagcttcgctcgtgaaggatggatggacgccgcatgcccgacgaccgcaggcccgacgaccgcccgcccgacgagacacccgtgctctacgagcgccgcggcccggtcgcgtacgtgaccatgaaccgcccccgctaccgcaacgcgcagaacagcgcgatgacctacgcgctggacgacgccttctaccgggccgccgacgaccccgcggtgaaggtggtcgtcctcgccggggccggtgagcacttctccgcgggccacgacatcggcacccccggacgcgacgcccacctgccctcgaagcggcgggccggcctgtggtgggaccacaccggccggccgggcgccgagtcccgcttcgcgcgcgagtccgaggtgtacctggggatgtgccggcgctggcgggagctgccgaagccggtgatcgcctcggtgcgcggggcctgcgtggcgggcgggctgatgctggcgtgggtctgcgacctgatcgtggcgagcgaggacgccttcttcgcggacccggtcgtacggatgggcatcccgggcgtcgagtacttcgcgcacccgtgggcgatgccgccccggatcgcgaaggagttcctctacaccggcgaccggatgccggcccggcgcgcgtacgaggtcggcatggtcaaccgggtcgtggcaccggacggcctggaggacgagaccgagcggctggcgctgcggatcgccgggatgcccgccttcggactggcgctgaccaaacgggccgtcaaccaggccgaggacctccaggggctgcacaccggcatggactcggtgttcggcctgcaccacctcgcccacgcgcacaacgcggagacgacggcggacccgctcggcggcatggacgtgtccgccatgaaggacgccgccatgaaggaggcgaacacctgatggaactcacgcacacggcggacgtggaggccttccgggccgaggcccgcgactggctccgcgcccacgtcccggcccggcccctgccctccctggagaccgccgagggcttcgcggcgcaccgggagtgggaggcgcggctgcacgcggaccgctggtcggtggtctcgtggcccgaggagtacggcggccggggcgtggacatcgtcacctggctggtcttcgaggaggagtactgggccgcgggcgcgcccggccgggtctcgcagaacggcatcaacctcctcgcccccacgctcttcgaccacgcgagcgccgagcagcgcgcgcgggtgctgccgtcgatggcgggcggcgaggtcgtctgggcgcaggcctggtcggagccggagtcgggctcggacctggcctcgctgaagtcgcgggcggtccgcgcggagggcggctggctgctgtccgggcagaagacctggtcctcgcgggcggcgttcgcggaccgcgccttcgggatcttccgcaccgacccggacaccccgaagccgcaccaggggctgacgtacctgatgttcgacctgcgggcaccgggggtgacggtgcggcccatcgggcgcctcgacggcaagccggccttcgcggagctcttcctcgaccgggtcttcgtaccggacgaggacgtcatcggggagccgggacagggctggcggatcgccatgtcgacgaccggcaacgaacgcgggctgaccctgcgctcccccggccgtttcctggcggcggcggaccggctggtcgcgctgtggcgggcgcagggggacccgtccgactccgcgctgcgggaccgggtggcggacgcggtggtcggggcgcgcgcgtacgagctgttcacctgggcgaacgcctcgtgcttcgcggcgggcgggacgatcggcgccgagtccagcctgaacaaggtgttctggtcgcagtacgacatcgccctgcacgagacggcgctggacctgctgggcgcggacgcggagctggcggacggcgagtgggccgagccgtgggtgttctccctcgccgggccgatctacgccgggacgaacgagatccagcgcgacatcatcgccgagcggctgctcggcctcccgaagggccgccgctgatgcgcttcctgccgaccgacgagcagtcggacttcgcccgtacgctgcgctccctgctcggctcggcaccggtcccggcggcggtccgggcctgggcggacggcgacttcgggcccgggcgggcgctgtggtcgcggctcgcggggacgggtctgttcgcgctggccgtcccggagcgccacgagggcgcgggcccgctcccgctggagctgtccctcggcttcgtggagctgggccgggccggggtgccgggtccggtggtggagagcgccgcggtgtcggtgctgctggcggagctggcggacgaggcgctcgccaagcggttcctgccggggctggcccagggcgagcactcggccacgctgaccctgccgggcgggagcccgtacgcgctggacgcggatgcggcgacgtactgcttcacggtgtcaccggcgggcgaactgcggctggtggccgaagggggcggcacgggccgggcggacggggcggaccccgtggacccggtggaccgggcggagggggcggacgggccggtgcggtcgacggaccccgcgcgccggctgtccgtcccgccggccggccggggtgaactgctggcggccggaccggcggtgacccgggcggccgaggtggcggcgcgctgggcccggctgctgacggccgcccagtgcctgggcgccggcgaggcgatgctggcgcggacggtggagtacgccaagcagcgtacgcagttcggtacgccgatcgggagcttccaggcggtgaagcaccggctggcggacaccctgctcgacctggagttcgcccggccgctggtgtgggcggcggcgctgtccctcgctccgggcgaggtggcggcggcgaaactggcggccggcgaggcgtcctaccgggcggcgatgacggcgctccagctccacggcgcggtgggctacaccgaggagctggacctgtccctgtggctgcgcaaggcccgcccgctgcgggacgcctggggaacgccgtcggcctgccgggccgaggtcctgcggtccctcacaccaccgcgacgctgagctgcacggcgtactgctcctcgacgacgccgtccgggaagagcggctccagcagctcccgctcccccgcgaagtacgcgcgggtgcgctcctcgcccaggaccaggaaggcggagtggctggcgaggttggcgaggtggtcgtccagcgtgatgtgccgggaccacgtcaccgaccgggtggtgaactcgccgatcccctcgggcagggtgcggtgggtctcccccttgacctcgaagaagacccggagccgctcctcctgttcggcgatccacgggacggtggtgtccgtgtcgttccaccagagcgcgagtgcgccgccggggcgcagcacccggcgggcctcgggcacggagcgggccgggtcggtccagtgccaggcctgggcgtaggtgatcaggtcgacggagccggaggccagcggcagccggttcccgtcgccgcgcacgatcgggacgccggggcaggtccggcggaactcggccgccatcccgtccccgggctccacggcgaggacctcggccccgcgctcgcgcaggagcgcggtggcgatcccggtgccggctcccacgtcggccacccgcgcactggcgagcggccgcccggtgagggactcgacggcgtcgaagagggccgggggatagccggggcggtgggccgcgtacagggcggctgccgcgtcgaaggagcgggcacgtgtcgtcatgcgtccattgttttcgatcacgcaatcggcaacaaggcaggggtacttgtgccctacggagggtgatggccgggtcgaccgggcacgccgtggcggtgcccgatctcacgcagagtgatagtccgtgttcaccgggggcgggagcggcccctgttcgcagcccgggccgcatcgcgcacacccgggataatggggcgatatgggccttacgttcttcgatgacaggcgtctggcgtgtgacctctatgccgcggcgagccagcgcaccggccccgaagaggtcggagcggggatctcgcgcgtgctcgcccccatcgtgtcccacgacgcgctgagcctggtgggaaccgacccggcgaccggtcccgggctgggcagcttcagtttctggcaccagtacgaccccgcgctggtcagggagctcgtcatgcaccggcatctgggcgacccgcggcggccggcggtcccgaccctcctgcggaccccggccgtcgtcgtgggcgcgggcagcgacgggtcgcccgcgcccgacccgcgcatgcggaagatcctcaccgcccacggggccggttccgagctgcgtctgctcctccgggacaggcgcggcgtgtggggggccctcgggctgctccgctgcgaaggtgccgcgccgttcggcgaggacgacgcccggcgggcggcccggctcgtaccggcgctgatggccgccctgcgccggtacgcgacggccggtcccctgtgccccgaggttcccccgctgtcggcgggagtgatcaccgtcggttccgaccaccggatcggggccgtcagcccccaggcgcagctgtggctggaccagtggtcggcgcacggcgctcccccttgggtcgcggaagccttcttcgtctcgctctcgctcgtcgcccgggcggaagcccgccgcgagggcgggtcgatccccctggtgtgcgcgccaccggccgccaccggccgctggaccacctgtcagggccacgtgctcgacgcgggcggcacgggcgatgtcgccctcgtcatccagggggctacctgggacctggtcctgccctcgttgtgcgagtggtacggcatcaccccccgggaacgcgatgtcgtcacgcagctccgcacgggggcgtccgtcaagcagatcgcccgccgcctcggcctgtccgcgtacacggtcaacgaccacctcaaggcggtcttccgcaagaccggggcggacgggcgcgacgaactcagtgccgccctgacccgctgacccgctgacccgcggtgtgtacatccccgatttcagggggtcgcagcgacagggaaccctcccaccatggggagagaagaccggagcacaccacgtccggtccaccgcggatccccgcacgggaatggcgtacggacgccgacgcgctctgccgtgccgggatcccctcctcaccgaagggaacggacatgacccacagcaatcttcgtgaaccctcgaccgggaacacggcaagcggcagcccggtgcaggccgggccggggcgggcgatccccgccacggacgcaagcgggggcaagccactgctgaatccggagatggccgcccggcccttcgacttccggggccacggtgtgttcgaaagggaggtgacgctgccgggctcccgcggagcgggcaccatggtgctcgccagcatcacggagttcagccccgtcaccgacgatcccatcatgggatccgcgatcgtcaccctgcacagcgtggcgccccagagcgggggcaccgtgaaggtccgtatggaagtgcgctggcccgaagacctctccgtcagggtccagttcatgtacttcctctgaacccgctctccgacccggcaggaccccgtgggggcgcgggcaaccgcgcccccaccgggacggaacgcccttcaagggctggggcggcgcagggagatccggccgacgacgacggtctggagcaggatcagggccccggtgccgacggcgggccaccgcggccggtccgggcgcccgccgacggaccaggccggtccgccggggtccaccgtcacggtcagccgggcgccgaccgggaggtccgacgccaccgggccgggcaggtcccggcccgcctcggtgcgcagccgcagggccggggccgaaccgtcctcccccgtggtccgctcgaccacgaccgcccgttcctcgcggccgcggtcgtggagggtgtgccggtcccaggtgttccctccggccacggcgatgccgaccgcgaggagcgcgacgacggtgcgggcgacgaactccgcgtcggtgccgtgcggtacggccgcgccgacgacgaagacggccagcaggaccgggatccaggccccctcgggcccctggagcagccggatcgcaccgaactccactgccaggagaaggccgttgcgcagcgcggcgcccggcagtctccgtatcagttccgtcatgcacacatcatgcccgggaggtcggcgggcacctctcctccacccccgccacccaggatccggccgcccgtagcgcggcggcgcccgccggcagcggcaggcccagaaaaccgtggaagacccccgggtggagctggagcgtgcagtcgaccccggcccccgccagccggcgggcgtacgcgaggccctcgtcgcgcagcgggtcgcagtcggcgaggacgatcagggcgggcggcaggcccgacaggtcgcgggcgcgcagcggcgagacgtgcgggtgctccgggtcgccgccgtacgcgtcccagtaccaggccatgtgggcggcggtgtggaagtagccctccgcgtacgtctccacggaggcggagtccatccgggcgtccagcggcggatagaacagcacctgtcccgcgacgagttcgggtgcgcgcagggcggtcacggccgcgaggttgccgccgctggagtcccccgccagcaccacccggccggggtcgcagccgagcgcgcgggcccgctcccgggcccagagcaggaccgtcagcgcgtcgtcgggcgccgccggccaggggtgttccggggcgagccggtagtccgccgagacgaccgcggcgcccgccgccagggccagggagcggcaggtcgcgtcgtgggtgtccaggccgcacatgacccagccgccgccgtgcaggtacacgaccaggggccggccggcccggccgggcgcgggatcgtagatccgcaccgggaccccgtccgcgatggtgtcggacaccgaggccacggccggaccctcccggccggacccggacgccacggccgcccgcagggcgcggaggtcgcccggccccgggaaaccggcggtcatcgcgtcgcacagcgtccgggcccgcggtgagagcgcgtcggctgcgaggtggcctctcatgccgtcgtcatccccccgtccacggtgaactcgccgcccgtgatgtacgaggaggcgtccgagcagaggaagaggacgagctccccgacctcctccgggcggcccatccgccccagcggtacgtgcgaccagtcccggcccgccaccgccccggccaccatcggggtgtcgatggcccccgggtgcaccgagttgacccggatccggtccccggcgaggtcgagcgccgccgagcgggtcagtccgcgcagcgcgaacttggtggatccgtaggcggcatggcccggtatcccgaccagtccggcggtggaggagatgttcacgacggagccgcccccgcccgcccgcagcacgggggccaccgcctggatgccgaggaacgggccgagcaggttgacccgcaggagcgcctcgaagtcctccacccgctgccgctccacgtgggcggtgcgccacagggccgcgttgttgaccagcgccgagatggttccgaaggcgccgaccgaccgttccaccaccgtcgcccagcccgccgcgtcggccacgtcgtggcggacgtacagtccctggtcgccgagtccggcggccaccgcccggccctcctcctcccgtacgtcggtgacgacgacccgggcccccgcctccgcgcacagccgggcctcggccgcgccctggccgcgtccggcgccggtgatcacgacgaccttcccgtcgagccgcccgcccatggctcagccctccagcgcgcggaagtgcgggatggtctccatgcgcacctcctggggggcggtgtccatccgtatgaagatcatcgagaacgtcacggtgcggtccctccatccggattccgaagaggtacttcgaataggaatacttctagcaggcacatcctgcagggggaagggtgccgcggggaccggtcgtagactgcgctgcgtggcagacgagacgaacatgcggacgctccccgcgaccagctgggcggtgctcgggctgctctccttcggggaggagctctccggttacgacctgaagaagtggtcggaccggtctctgcgcttcttctactggagcccgtcgttcagccagatctacagcgagctcaagcggctggagaaggccggctacgcgtcctcgcggatggtcgcccaggacaccgggacgcgcgacaagcgggtctaccggatcacggacgagggcatggcggccgtacgggagtgggcccgcgagacccccgtcgacccgccggtcctcaagcacggaccgatgctgcgactgtggctggggcacctgctggagcccgagcagatgcgcgaagtcctgctccagcagcaggagttcgcggaggggatgcgcctgcgcgcggtcgccgacgcggagggcgcgaaggacgggagcgcctgggcgtacccgacgctcactctcaggtgggccgagcggtactacgcctccgagcgcgatctcgcggccgcgatgctcgacgacatcgacgagctcgacgggtccggcgggccagtcaggcccgacggtcccggcgagcttccgtaggaacgccggaggtacagcggcggaggaccgccgcggtgcgcggtcggcgcgctgccgtacgctcacgccatgacgggcagtgcgatcgacctccgcaaggtggaggagacggctccggcactcgtgagcctctacaagagcgccggggtctccctgcgcaagtacggcatggagggcggccgggcggcggtctacctggtgctggactactccgggtcgatgaagccgtactacgcggacggcagtgtgcaggccctggcggaccgggtgctggggctgtccgcgcacctggacgacgatgcccgcgtgccggtggtcttcttctcgaccgaggtggacgcggtggaggagatctccctggccgggcacgagggccgggtcaccgagatcgcctcccggctgggccacatgggcaagaccgcctaccacgcggcgatggacgcggtcatcgaccactacctggactcgggtgcgacggcgcccgccctggtcgtcttccagaccgacggcgggccgatcaacaagctcgcggcggagcggtacctgtgcaaggcggcccggctgccgctcttctggcagttcgtcggcttcggcaacacgcgcagcacgcagttcgacttcctgcgccggctggacgagctgccggtgcctgcgatgcggatcgttgacaacgcgggctacttccacgcgggagccgacccccgcgcggtgccggacgccgagctctacgaccgcctgcttggggagttcccggcctggctggcggcggcacgcggggcgggcatcgtgcgcgcctgacccgcgcccgccggtgcccgcgctttgatggacgtatgacgcataccagctgggcagtcttcgagcaggcggagccggagttcgctgcggccgtccaggcccgtttcgcgcagtatccgcaccacgtcctggccaccctgcgcaaggacggctccccccgcgcggccgggctgaacgtcgacatccggggcggggagctgtggctcggcatgatgttcggctcgatgaaggccagggacctccagcacgacccgcgcttcgccctgcacaccaacccgggcgcgggcgaggacatgccggacggggacgcccggatctccgggcgcgcggtggagctcgtggacccgcccgagctgcaccggtacgcggaggagacggagaccccgcaccccttccacctcttctacgccgacctgacggaggtcgtccgggtccgggtggagggcgacgagctggtggtgcggtcctggaccccggagcacggcctgcgcaccctgcgccgggccgacgacgacgaaccgccgcgcgaggaccacgacgctctctagcgctccggccgggtacgacaaattcgttacccggcggccgaagtgccgtgatacacaaccgaagtgcacaagatattggagttccccgaggccctgcggctgatcgaagaccgctcggccgcgttccgcgccgcgatcgcgtccgcccccgaccttgacgtccaggtcccgacctgcccggactggacgctgcgcgaactggcgcagcaccttggtgacggccgccgccgccaggccgccatcgtcgcggcgggcccgggcgccgagcccccggcgaggacggacccgaagggcgccccgaccgcgccccgcgaccgcgaagccctggacgcctggctcgccgagtcgaccgggctcatgctcgacgcgatgcgcgaggccggcccggaccgcggctgctggacctggtggggccgctcgcaggccccggagaccagtggagccctggcccggcaccagatccaggagttcgctgtccacacctacgacgtccagctcaccctgggcgccgcacagccgctgccgacggacgtcgcggtcgagggcgtcgacgagttcctgacgaccgtctcggcgacgagcgtcccctggccgttcaagccggcgaccatcgacctgcacgcgaccgagggcggctcctggcgcctgaccctcgacgccgacggcgtccgctgcgacgacctcgccgccgacgcggagccgggcgacctggtgatgcgaggcgcggcgagcgaactggtcctctacttctacgaccgcatcccgctcgacagcgtgcagagcaccggcgacaccgagccgatggagcagctcgcggagtgggacccgaacgcgtagacgtgtacgtgtgacgcgcctgccggctgcctcctagaaacccttgcggccgaccgggccgagggcggcggggttcacgtccacccagctgcggtcgatggtgaggccgaccccgccgtaggtggccttgtggtcgccgcggaactggtgggcacggcgcgggccgacccacttggcggtgcccttggccaggcccatgtcggcgtcgcccacggtggccgaaaggttccagcgcgcggaccagagtacgtccggcatggcgtgcggggcctggtggtagtgggccttcagcgccttgaccccggagctcaccgagacgtaggcggcggagcggaagcccagctcgtgcagccggtccgtccaagcggtgaggtaggcgacgacgggggcgtcccaggtggcgcggtcggtgtagttctccaggtcgttgtagagcaccgtgccctcggcaagccgcagcgaccgggccgcgtccaccgcgccctcggcggcctcccggccctgcgcattggcctcggaggggtcggtggacaggccggtgccggcatggtgccagggctgcgggcccacccagatcggcatcaggtgccagcccgcggcggcctgccgctccacccagcgggccgtgaggcgcggctgtgcgcaggcccgggcccggccgccgatgtagacgccgatcgcgccgaagggggaggcggcccgccaggcgtccatggtcttctgggtgggggcggtacaggcgtcgaagccctcgcccttgaaggggtcctgggcggtacggggcttcgggccgccggtggccggcacggccacgacggggggccgggcgggcgcgggcgccacggcgcgggcccgcgccaggacccgccgcacgccgtcgggcgtggccccgtaggagacggtggccatgatcccggaccggtggagggcgtaccgcagctcgttgctgtcggagcggggcgggacctcgcgcggcaggctccgggagtccacgtcgacggtcgggacgtcggcgcgctccggggctccgtcgaggggttcgaggtgcagggtgtcggcgcggccgaccacggcccggccggtgcactcggcctgggtgccggcgtggccgaggtacagggtgggcaggtccaggcgcagacaggcgtcggggttccggtcgaggtcgacgaccctccagtcggcggggagggcgaggcgcaggccccggtagtcgacggtctgcgcctcggcggcgggagcggcgccggcggacgtgccggggatcagcagggcggtgccgagcaggccgctcagcagcgttcggatgggggccatgatccagatgggtaccagacggcggccgccgcgaactgtgcgcgtgcggaatgcagttggcccgtccggcctatccccgcccagccgggcccgccggcccgggtcacctgcacgagtgacgcgggcccgggcccgtcaccgcgggccgcgggcccggtacggctgggcgagtaaggtcgagggggcggccgaagccagttgcgttggcttcggccgcccctttttccccttctccgcgacccggtcagacggcccggcggcgcagccaccaggagcagaacccggccagcagcccggagagcgcgaggaagatccccgtctcgatccactggaaggtccagtagcggtcggcgggctggtagtcgacctctatgtggaggtccgaggtggcgaagcagccgaaggggtccgccttgggatcggcgcagcccttggcccctcggacctcgtggccggcggggtcgagcaccgcaccggggtcggacacgacccagacgccgggcttgaggaccccgacccgcagatgggtgtcgtctccggagcccatcagctggacgtggttcccgttccagccctccgccggagcgccggacgatccgtcgctgccggtcggcgccatgacgagggagctgagcgcgacgtcggcgcgctccggcgtcatgtagtgcgggcggatcgcgaaggggacgaggatctggaccgcgaggaaggcgacgagggtcgcggccatcgcgggcacggtgcgccggatcaggagtccggcgcaggcgccgagggtgaaggcgaacgccgcgtagccgagggggacgatcgcccgcccgctgaacatgagggcggtgaaccggtccaggttgacctggtcgatggggtgcgcccaccaggtcaccaggaggctgagcagcccggtgacggcgacggcggtcaggccgacgcccgcgagcttgaccaggagccagtggcctcgggtgatgctctggttccagatgagccggtgggtgccggtctccagttcacgggcgatcagcggggcgccccagaagagcccgatgatgccgggggtggcgagcagcaggctcgtcacgtagtaggtcagggtccggtattcgacgaccagcgcgttccgggccctttcgcagtcgccccggcagtcggcgacggtgctgtcgtagaggtcacgcatctggaggccggtgaccacgaggaatatcgcgagcgcggccaggacggcgagcgcggcgagggtctggacgcggtattggcgccaggtcagccagatcatcgctggttctcccgggtgggtcggtggccggacccggccgtggcctggctcatgtaggtgaggacgaggtcctccaggttgagcggctccaggacccaggagggatcctggaccgccttgtcggagcgcacgatgaaggtgctctgccgctcggtgtgggtctccaggacgacccgcatgccctggggcagggtggccgcctcgcggcgggcggtggtgagccggaagtgggtggcgagcaggtcgtcgacgtcgccggagagctggacccgggaggcgaccagcgagatcaggtggtcgcagacccgttccaggtcggagaccaggtgcgaggagagcaccacggtggttccgtgttcggccacgacctccatcaggctctgcaggaactcccgccgggccagcgggtccagggcggcgacgggctcgtcgaggatcagcagctcgggccgtttggccacggcgagggtcagggccacctgggcgcgctggccgccggagagcttgcccgccttctgggcggggtccaggccgagctgccggatccgctcctcggccagctgtgcgtcccagcccgggttgagccgggcgccgaggcgcaggtggtcggcgatggacagccccgcgtaggtgggggtgtcctgggcgacgaagccgaccttggccagctgcccgggcccggaggcgggccggccgccgagcacctcgatgctgcccgaggtcgggccgatcagcccgcaggccagctgcaacagggtggacttcccggccccgttgggcccgaccaggccgacgacccgcccggacggcacgctcagggtgcagtcgctgagcgccactttgcggccgtaccgcttgcccagcgcgcgggcttccaatatgacggtcatttctcctcttcggtgtgcgtgtgcgggtccgtgccggtgcgggcgcggaaggtgctcaggaacagggcctcgatgctctcctcgcccagcccggcggtccgcgccttgtcgagccacagctgcaactcccggcggagcggctcgtgttcggagagcgagtcgtcgctgagcgtcccggagatgaaggtgccgaccccgggcttcttcgcgaccaggccctcgtactccagctcccggtaggccttgagcacggtgttggggttgatcgccacgccggccgcgacgtccttgacggtcggcagccggtccccttcggccagcaggcccaaccgcagtgcctgtcgcacctggtggacgagctgcatgtacggggcgacgccggagcgggcatcgaggtgaaactcgatcactgtcctcctctattcatctagcttcctagcactataggactacgcatatccgatcactgtcaaccgagtggacgtcaacacggccgcgagcggcccggattggggacggagcggactgagtacgcgtactcaggcagatgtcagtaccgctgggtagcgtcacgactgtccgacgaacggacgacacgacaacctgggggatgacatgaagaagcacacgaccgccctggcggccttggccccggctctcgcactggccctggcggcgagcccggcccaggccgcgccgacgggcgaggtcatcggctacccgggccccgacggcctgatctggatcgccgaccaggccggttccagcggcttcgtctcgggcggcctctccgcagagctggacacgttcatcaccttcggctgcgccgagggcgggagcatcgaggtgtcgttccgcctcgacgagcacccggaccgcaacccggcccccttcaccgtcgactgccccggcacggacccgacggtggtcacactccccctcggcaccggcctccacggcggcttcaccgcgtgggtgaccgcctcgaccccgaccacccactggggcgccacggtcacccagcccgagtagccccgaacacaccgcagcgcccgccacccctggtcggggacgtggcgggcgctgcgacttgaagccgggctccgtcgcatagcgcggagtcgacggagcgggcttcaggtgtgggaggcatggtgagcggcggtgagtggaccagtaggtcgatgccgtatctgaccgcccagccgccgggcgcggcggacgcgtggacggaggaggccgcgacagcaggacggcggggcagtcggcgcatcctgcatgccggagaggtggtagcccccgcccgcgtcgccctcatgctcgggccggcggccggaagtacggtcgcaacgcgacacaggctgatcgaactcgacgacgagccgacggagttgaccgacacgtactaccccagggacatcgccgtcggcacggcgctcgccggcgcggcgaagatccgcggcgacgccgtgacgctgccggccgccctgggcctcagtctccaagatccccgatctcgtcacccgcgatcagctctgcgtctcctcgcggcgtccgacagcggccgcatcgggtacgaggagcagcttgccggtggtacgccgagcctccagatcgctgtgggcctgggcggcctcggacaatgcgtagcggcccgttacggtgacctcgagcgccttggagcgcacccactcgaacacatcggcggcccgtcggagcagttcggaccgatcggcgatgaagtccccgaggctgggccggatcagggtcagcgaaccgccgtgggcgagccgcatcggatcgaacggcggcacggcaccacttgccgcgccgaagagcacgagatggccgcgggttcgcaggctggcgaggctcgcatcgaaggtgtgcgcgccgacgccgtcgaagacaaccggcagtccctgaccgccgttgagccgcctcacctcggctgcgagatcgtcgaccgcggaggaaagaatcacctcagcggccccggcacgcttcgccagcccggccttcgccgtagtcgacgtcgtgccgatcaccctgccgccgagatgggtgatgagctgggtcaaagcagccccatgccgccagcagccgcatgcacgagcaccgtgtcgcccccctgaaccgggtaggcgtccttgacgagatagtgcgcggtcatgccttggaggagcacggcggcggctgtctcgaagccgatgtcgtcgggcagcggcaccagccgggaggagtccacgacggcccgctcggcatacgtaccgggaatctccacccaaccgacccggtcccccactgcgacgtcagcgacgccgggtccgacttcgacgaccgtgccggcgccctcggcgcccggggtgaagggcagcgggaggctgtaccggccttcgcggtggtagacgtcgaggaagttgaccccggatgcggcgacctccacgaccgcctcgccgggacccggccgcggctggtccaccgtggcctcctgcagcacctcgggaccgcccacttcgtacacctgaatcgctcgcatggccctccaataacggctcatccccaccaaccccgttgatggcgatcaacggctcatccccaccaacctcgttgatggcgatccgattcccggcagcagaccagcccgccgcccccgccgagagccgagacgcctgctccgcacccgggtgacgaaccgggccctaccggccccagaccagcggcaaggtcgaacgcttcaaccgcaccctgctcgacgaatgggtctacgcccgcccctaccggtcagacatcgaacgccgcgaagcgttcgccggctggctccactcctacaatcaccaccgcggacacaccgcactcgcaggcaaaccacccgcaagccgcgtcccaacctgacgaggcaataccacctgaggcacgtcggcgtgcgggtcgtggaggccgtgacgtcgcagatcccgcgcgaagaggaacgtgagcgactgcgtctcggggcgggtgaaccggtcctgcgcctgacccgcaccacctacgacgccggggaccgccccatccaggcggacgtgatgctcatgccggccggacgccagcagttgcgctacgagatcaggctcggccctgcacagcctggatgaacggagcccatacggcggcggggaagagcaggaccggcccggcgccggccagcttgctgtcgcggaccgggacgatgccggggaggtcgtcggacacctcgacgcagctgccgccgtctccgttgctgtacgaggacttgcgccaggacaggccgttcacgtctgcgcgcacgtcgcgtactcctccgccaccgactcgatcagggtcagggacacctccggcgacagcgcagcggccctggcaagatcgtatgacctccagtagcgctgaaccagggccggatagtcgagcagctgccctgagtgggggccctcggtgtacgccacatcgggcgcgtcggtgaactgcatgatggtcatcatcgaacccagcgctccatgggccccggccgcgaacggcacgacctgcacggtgatccggtgggcacgggcgtacgaagcgatgtgccgcaactgagccgccatcacagcagggcctcctaccgctgtgcgcagcaccgactcgtgcaggaccacccacatctcaggggtttccggatcgacgagaagtcgtgcgcgttcgatgcgtgccgcgaccagggcgtcaacacgctcggcaagcgcagtcggcttggcggcccggatcaccgcccgggcataggcctccgtctggagcagccccggaaccagggtgggggcgtactcgtagagggccgtcgccagtccttccaactcggccgcggcggcgaagtattcgctgtgcttggatttgaacgccctggccagacggaagaagtagtcccccgtgtcgagctcccggtcgatgagcctggcgatctcggggcgcagccgacgacgcccgctctccatcatcccgacgtacgcccccgtggcgaagatgcgctcgcccagcccttcctgggtcagccccgccgcctcgcgcttcccccgcagctcctcgcgggcgaactcctccggcgtctgcgccccaccctcgtcattcggcttggccatgcgccaactccccgcctccgcagtgccctcgctccgcaaaaagcgtagtcccggccgcagcgacggttcagcggaacgcattgatacgactactcaacgccacagcgcccgccacccctggtcggggacgtggcgggcgctgtgtcgggtgttccgtacaccgttgtacggaccgtatgaggggtcccgcccttcgcggggcgggggtgccggcggtgctacaccgtcagcgagcggtccgtcggcttgaccgggtacgggagggcgctgctgccggtcaggaagcggtccacgccgcgggcggccgagcggccttccgcgatggcccagacgatgagcgactggccgcggcccgcgtcgccggcgacgaagacgccgtccacgttggtcgcgtaggaggcgtcgcggtcgatgttgccgcgggcgtccagctccaggccgaactgctggaccagaccgttcgcctggtccgtgcccgtgaagcccatcgccagggtgaccagctgcgcggggaggacgcgctcggtgcccggcttctggacgagcttgccgtcctcgaaggcgacctcgaccaggtggagggcctggacgttgccgtcctcgtcgccctcgaagtgggtggtggagacggagtagacccgctcgccgccctcctcgtgggccgaggtgaccttgtagagcatcgggaaggtcggccacggctggttggagttacggtcctcgcccggcttgggcatgatctccagctgcgtgaccgaggccgcgccctggcggtgggcggtgcccacgcagtccgcgccggtgtcgccgccgccgatgacgaccacgtgcttgccctcggccgtgatggggggcgccatgaagtcgccctcctggaccttgttggcgagcggcaggtactccatcgcgaagtggatgccgttgagctcgcggcccgggaccggcaggtcgcgggagacggtcgcgcccgccgcgacgaccaccgcgtcgaaccgcttgcgcaggtcggtggcggtgatgtcgcggccgacctcgacgccggtgcggaacttggtgccctccgcgcgcatctgctcgatgcggcggttgatgtgcaccttctccatcttgaactcggggatgccgtagcgcagcaggccgccgatgcggtccgcgcgctcgtacacgacgacggtgtggccggcccgggtcagctgctgggcggcggcgagacccgccgggcccgagccgatgacggcggccgtcttgccggacagccgctccggcgcctgcggggtgacgtcgccgttgtcccacgccttgtcgatgatcgagacttcgacgttcttgatggtcacggcgggctggttgatgccgagcacgcacgccgactcgcagggggccgggcacagccgcccggtgaactccgggaagttgttcgtcgcgtgcaggcgctccgacgcggcggtccagtcctcgcggtacgagaagtcgttccactccgggatcaggttcccgagcggacacccgttgtggcagaacgggatgccgcagtccatgcagcggccggcctgcttgctgatgatcgggagcagcgagcccgggacgtagacctcgttccagtccttcagccggtcggctacgggacgggtgcaggcggtctcgcggggggtggtgaggaagcccttcgggtcagccatgggtcgccgcctccatcatcttctccgtggtctcggattccgagagtccggcgagctcagcggcgtccttggcggcgagcactgccttgtacgtggtggggatgatcttgctgaagcggtccaccgcgacggaccagtcagccaggagcttcgcggccacggtcgagccggtctcctcctcgtggcggcgcaccacatcgtgcagccactgcttgtcgctgtcggacaggacggtctcgaccgcgcccgcgttgccgacgttgacgttgtgcgggtcgaggtcgatgacgtacgcgacgccgcccgacatgccggccgcgaagttgcggcccgtctcgcccaggacgaccgcccggccaccggtcatgtactcgcagccgtggtcgcccacgccctccgagacgaccagcgcgcccgagttgcggacgcagaagcgctcgccggtgcggccgcgcaggaacatctcgccgccggtggctccgtagccgatggtgttgccggcgatggtggagtactcggcgaggtggtcggcgccgcggtccgggcggaccacgatgcggccgccggagaggcccttgccgacgtagtcgttggcgtcgccctccaggcggagggtgacccccttcgggacgaaggcgccgaaggactggccggccgagcccgtgaaggtcaggtcgatggtgttgtcgggcaggcccgcaccgccgaacttcttcgtgacgtggtggccgagcatcgtgccgacggtccggttgatgttgcggatcgcaacctgggcgcggaccggctgcgcggactcggcgctctcggcgttcagcgcgtcggcggcgagctcgatcagctcgttgtcgagggccttctccagaccgtggtcctgctcgatcagggcgtggcggaccgcgccctcgggcagctccggcacgtagaagagcggctccaggtcgagaccctgcgccttccagtgcgtgacggccgcggtggtgtcgagcagctcggcgtggccgacggcctcctcgatcgtacggaagcccagctcggcgaggagctcgcgcacctcctccgcgatgtactcgaagaagttgacgacgaactcgggcttgccggagaagcggtcgcgcaggaccgggttctgggtggcgatgccgaccgggcaggtgtccaggtggcagacgcgcatcatgacgcagccggagacgacgagcggcgcggtcgcgaaaccgaactcctcggcgccgagcagcgcggcgatgaccacgtcacggccggtcttgagctggccgtccgtctggacgacgatccggtcgcgcagcccgttgagcagcagggtctgctgggtctcggcgaggccgagctcccaggggccgcccgcgtgcttgagcgaggtgagcggggaggcgcccgtaccgccgtcgtggccggagatgaggacgacgtccgcgtgggccttggagacacccgcggcgaccgtacccacgccgacctcggagaccagcttcacgtggatgcgggcgaccgggttggcgttcttgaggtcgtggatcagctgagccaggtcctcgatggagtagatgtcgtggtgcggcggcggggagatcaggccgacgcccggggtggagtgccgggtcttggcgacccacgggtagaccttgtggccgggcagctggccgccctcgccgggcttggcgccctgcgccatcttgatctggatgtcgtccgcgttgaccaggtactccgaggtcacgccgaagcggccggaggcgacctgcttgatggacgagcggcgcgccgggtcgtacaggcggtccgggtcctcgccgccctcaccggtgttggacttggcgcccagctggttcatggcgatggcgagggtctcgtgcgcctccttggagatggagccgtacgacatggcgccggtggagaagcgcttgacgatgtcggcgaccgactcgacctcgtcgatggagatggcttcgcggtccgacttgaagccgaacaggccgcggagcgtcatcaggcgctcggactgctcgttcacccgggccgtgtactgcttgaagatgtcgtaccggcggttgcgggtggcgtgctggaggcggaagaccgtctccgggtcaaacaggtgcggctcgccctcgcggcgccactggtactcgccgccgatctccagcgcgcggtgcgtggccgcgatgccggaggccgggtacgccttggcgtggcgcgcggccacctccttggcgatgacgtccaggccggcgccgccgatcttggtggcggtgccgttgaagtaggtctcgacgaactcgtcgttgaggccgacggcctcgaagacctgggcgccgcggtaggaggcgacggtggagatgcccatcttggacatgaccttcaggacgcccttgccgagcgcgtagatcaggttcttgatggcctgctccggctccaggccggacaggaaggtaccggcgcgcagcaggtcctcgacggactccatggcgaggtacgggttgaccgcggctgcgccgtagccgatgagcagggcgacgtggtggacctcgcggacgtcaccggcctcgacgagcagacccacctgggtgcgctgcttggtggcgatgaggtggtggtgcacggcggaggtgagcagcagcgacgggatcggcgcgtgctcggcgtccgagtggcggtccgagaggacgatcaggcgggcgccgttggcgatggccgcgtcggcctcggcgcggatctcctcgatccgggcggcgagggccccgccgccgccggagacccggtagaggccggagagcgtggcggccttcatgccgggcatgtcgccgtcggcgttgatgtggatgagcttggccagctcgtcgttgtcgatcaccgggaagggcagggtgacgctgcggcaggtcgcggcgttcgactccagcaggttgccggccgggccgagcgaggacagcagcgaggtgacgagctcctcgcggatggcgtccagcggcgggttggtgacctgcgcgaagagctgggtgaagtagtcgaagagcagccgggggcgctcggagagggccgcgatcggggagtccgtacccatggagccgagcggctcgccggcggtacgggccatcggcgcgaggatgacgcgcagctcttcctcggtgtagccgaaggtctgctggcggcgggtgaccgaggcgtgggtgtgcacgatgtgctcgcgctcgggcaggtccgacagctcgatctcgccggtctccagccactccgcgtagggcgcggcggcggccagctcgttcttgatctcgtcgtcctcgatgatccgcttctgggcggtgtcgacgaggaacatcttgccgggctgcaggcggcccttgcggacgaccttggccgggtcgatgtcgaggacgccgacctcggagccgaggacgacgaggccgtcgtcggtgacccagtagcggccggggcgcagaccgttgcggtcgaggaccgcgccgacctgggtgccgtcggtgaaggtgacgcaggccgggccgtcccagggctccatctgcgtggagtggtacttgtagaacgcgcggcgggccgggtccatggaggtgtggttctcccacgcctccgggatcatcatcagcacgctgtgcgggagggaccggccgccgaggtggagcagctccaggacctcgtcgaaggaggccgagtcggaggcgttcggggtgcagatcgggaagatccggtccagcgcgccctcgccgaaggcggcgctcgccagctgggactcgcgggccttcatccagttccggttgcccttgaccgtgttgatctcgccgttgtgcgcgacgaagcggtacgggtgggcgagcggccacgacgggaacgtgttcgtggagaagcgcgagtggaccagggcgacggccgaggcgaagcggcggtcggagaggtccgggaagaagggctccagctggccggtggtcagcatgcccttgtagacgatggtgcgggcggagagcgacgggaagtacacgccggcctcgcgctcggcgcgcttgcgcagcacgaaggccttgcggtccagctcgatgcccgtgctgccgttgctgacgaacagctgcgagaaggccggcatggtggcgcgggcgccgttgccgagcaggtccgggctgaccgggacctcgcgccagccgaggaccgtgaggttctcctgggcggcgagggcctcgatctgctccacggcgacggcctgtgcggtgccgtcggcggggaggaaggcgataccgacggcgtagccgccggcctcggggagctcgaagccggccacctcgcgcaggaacgcgtcggggacctggctgaggattccggcgccgtcgcccgagtccggctcggagccggtcgcgccgcggtgctcaaggttccgcaatacggtcagggcctgctcaacgagtgtgtgggtggcctcgccggtgaggttcgccacgaatccgacgccacaggcgtccttctcgttgcgcgggtcgtacatgccctgctgggcggggcgaccgtccatgggcgaccaggcggtggtgctggggccggtcgcggagtgcgtggatgcggaacgcatcggctctcccgtcgtcgtcgtggcatatgtgcatagccgagggacgacgttggccctctgcgaaatttcgtgcagattacatgatgacgacaatcccgagaagcggatacgccattccagcatgcggactgcacgaggcagaaagaggggactttcgcggcgctctacggaggtatcgcgcgaggcggaggtcccggtgcagggcgggcatcgttgcccggagccctggtgtgattcccggcggacacggattcgaaaccgccgggtaacggactacttatgttgcgtactgcatagtgtctcactccaggggcggtcagcctatggctgcgccgatccaggttcccaggatgtacgtcacaccggcggccgcgccacccaggaccagctggcgtacgccgctgtaccaccaggaccgggcggtgacccgggagacgaccgcaccgcaggcgaagaggccgaccagcgcgagcagcaccgcgggccacagggccgtggcaccgagcaggtacggcagtacgggcagcagcgcacccagcgcgaaggaaccgaaggacgagaccgcggcgaccagcggcgagggcaggtcgtcggggtcgatcccgagctcctcgcgggcgtggatctccagcgcctgctcgggatcgcgcgacagctgcatggcgacctcacgggcgagcgacggctcgaccccgcgggagacgtagagctcggcgagctcctccatctcgtcgaccgggtgcttgcgcaactgctggcgctccacgtccagttcggcgaggaccagttcgcgctgcgaggcgacggaggtgtattcgccggccgccatcgagaaggcgccggccgcgagacccgccagcccggtgatgacgacggtctgcggggcgacggcgccgccggccacaccggtcatcagggcgaggttggagacgagcccgtccatggccccgaagacggccggccgcagccatccaccgttgacgtcgcggtgggtgtggttgtcacggtgcgcggtgtgcagcggtgcttcgatgtcgatgatggacatgcgtggaatctccccaaatgtgcgtacggacggcgtgggtcgtcccgctccccctgaacacctcgaaactacgcacgatttctgccgcccgccagcaaggaaggccgtacttacctgggcttttgtgggtcggcgaccgggtgacgggggtgttctcggggtgtttcgcgacgagcgacaaaccacatgccatggcacaaatcccccaagggctcatgatgagccccatccaatgtgggagaggcgcgccatggagccggtgaagctgattgcatgcaatccgcaggtcctcctcgaacgggccaggggcgctcttctcggactcgcggtgggcgacgcgctgggcgcccccgccgagaacatgaagccgtcggagatccgggccagatggggccgcatcgaggggttcgtgtccgaggaccccgcgggcacggacgacaccgagtacgcgatcttctcggggctgctgctggcccggcacggctcggcgctcaccgtctcccacgtggagcgggcctggcaccactggatcgccgacctggacgaagggccgttccggggcgccgggttctcggagcgcggcaccctggagaacctccgccggggcctggccgcgcccatctcggcgcagcaccggcacgcctggtccgacggcctggccatgcgggccgcgccgttcggcgtcttcgccgcgggccggcccgcggaagcggcccggctcgtcgccatcgacggctcggtcagccacgacggcgagggcatctacggcggccaggcggtcgcggcgggcgtggccgcggccatggccgggggctccccggcctcggtggtgtcggcggccctgtccgtcatcccgtccgactcctggacggcccgctccctgcgccgggcggtcaccgccgccccgcggggtgaacgtgcggtgcgctcggcggtggtcatcggcggctacccgtggacggacctggccccggaggcggtcggcctggccttcggggcgttcgccgcgtgccggggcgacttcccgtcctccgtcctcaccgcggtgaacatgggccgcgacgccgacaccacggcggcggtggcgggcgccctggccggcgcgctgtcgggcgccgccgcgatccccgccgcctggtcctcggccatcggcccggtccgcggcagctgcctcccctcgatgcggggctaccacgtcctggacatcgcggacctcctcaccccggaatgcgaggccgcccgatgaccctctccccggacgacgtgaccaccacgtccccgcccccgcccgagccgagccccgccccgaccgggcgggtcctccggaaccccccgcccgccacggatccggctcccgccgagcagctctccggtggcccgcagtcgggcggaccgggcctcgccgaggcgccgccacgcgccctgccggccccgccgacggctccggcggagcccaagcccctaggcccggccccggtcggccgggcggcggcgcgcatgctgccggcgggcccggtcacgggtacgggcccgggtgggccggcactgcccgaggcgacgcgggccccgggtgcggccggaggcgtcctcgcgcccgcccccgggacggggtcccggatcgtggtccgggccggggccggggtcctggcccgggagcagtccgccgggctccccgcggggaaaccggcccgccccatcgaaggcctcctcctcgggctcgccgcgggcgacgcggccgggtggcccgccgcccggcaccgcgccagccgcatgcccgagtggacccgccgcctgacccgcgagctcgacaccttcgccgagcagaacgccaccaccaccctccccgtccccatcgccctcaaccagccccccgagcccctccgcctcggcccctccgacgacgccgagtgggccgccttcgtcgccgagtccgtgctcaccgccgccggcgtcctcctcagcgacctcagcaggtcgagaaggatgcgcgcggccatcgacctcgcgtggaacgccctggcctccgaggtcgccgcggcagcggaacgcgcgcccgaggtcgagtccgccgtcctccccctccgcgcccggatctccgtccgcgccggcctcggcaatctcgccaccggcctgcgcccgcccgccaccggccacgacaacccgcactacttcgacgacgccgcctgcgtccgcgcctgcgtcctcgccgtcgtccatcccggagacgcccgcgccgcggccgacctcgccgagttcgacgcccgctacacccaggacggcgacggggtgcacggtgcccgtgccatggcggccgccatcgccaccgcgctcaccacccccgacgtcgacgccgccgtggatgccgccctcgcccagctccccgaggccaccgagatcggccgcaacgcccggcacgccgtccggctcgcccgcacccgcaccgacggcggcggcgccttcgccatcgtccccaccctcgaacacgagatcgtcgaccacgtctacagctacgggatcgccgcggccgagaccgtccccgtggccctcgccctcgccaccgcggcccgcggcaggatgaccgaggccgtaccggccgccgcctgcctgtcccgtgtcgcggactccgcgcccgccctggccggagcgctgaccggcgtactcggcggcggcgactcgatccccgccgcctggcgcgaggcctgccgcaccctctccggctgcgccctcccccgcctcgccggcaccgacctcgtggaactcgccgcgctcctcgcggccacggaactcacctcacccaagggatgattcggacatgacgctcacgttggaggaccgggcccgcggcgctctcgtcggagccgccgtcggcgacgcgctcggcggcccggtggagggctggaccccggaccagatcgtggaacggcacggcggccgcgtgcacggcatcgtcggcccctggtacgaggactggcgtacggcccgccccatcgcgccgtaccacaagggcgacgggcacgtcacggacgacaccttgatgacgcacgcgctggtgcgggtctacgaagcggtacgggaccacctcgacgcctacgcggtcgccgagcacctggtccccgacctgatgtccaccccccgctggattccggagctggaagccgaagccctgccgctccagcggatcttcctcgccgagaagtggatcgtgacccggctgcactacgcccacgccgacccccgcgaggccggcagcggcaacatcgtcaactgcggcgcggcgatgtacatggcaccggtgggcatcgccaacgcgggcaatccggcgggcgcgtacgcggaggcgctggacatcgccggtgcgcaccagtcctcgtacggccgggaggcggcgggcgtgttcgcggcggcggtggcggcggcgtgcgtaccgggggcgacggcgtcgtcggtggtggacacggccctgtccctggccaaggacggcacgcgcgcggcgatcgccgccgtccgggaagtggccgccgggcaccgggacttcgagtcggcgctggcgccgctgcgggcggcggtggccccgtacgactcggtcggcccggactaccgcgcgccctcgctggacgcccgccgcccgtcccgcctgcacgccatcgaggaactcccggtcgcgctggggatgctgctcgtcgcggacggacggtacgagacggcggtcctcggcgcggtcaactacggccgggactgcgactccatcgccaccatggcgggggcgatcgccggggccctgggcggcgaggccgcggtcccggccgcctgggccaagcaggtcgccgaggccagccgcctcgacctgcacgcccccgccgaggcgatggccgcggtggcccgggaggtcttcgccctcgaccgctcccgccgcaggtcgcacgaatcggccttcaccgcgatcgcggacccccggtgacgggcaccgccggaccggccccggccgctcccgcgcgcccgccggaatcccgcgacgccccggacccggcccggcaccgcccccctcgggagcccggggcggacccggaacccggcccggggcacgggcccgtgcggctcacctgggcccagcccgaggacctggtcgggcacgagctgcgccaggccgccgaggacggccgggatgcgggtcccgccctgcgcgcctggctcgcggcgggcggctctcccgccccggaccgcgccggcgcctcccccgccccggccccaccggaactccgggcgctggccgtccgcctcctggacgccctggcggccctcccacccccctcccgcaccgacgaaccccagtcctggccggacatcaccaaggcctgcgggaccggctgcatgccccccggatccccgtccaccggtatccgggacccggacgccgacccggaacccgtgccgcggaccgggcccgcagccgcgcggccggatcccggactgcggaccaggctggaggccgcctggctcgggcgggccgtcgggtgcctgctcgggaagcccgtcgagaagctgccgctggaggggatccgggcgctgggccgcgccggcggcaactggccgctcgacgactggttcagcgaacgcggcgtaccaccggaggtgctggccgcccacccgtggaaccgccgttccgcccccacctccctcgccgagaacatcgacggcatgcccgaggacgacgacctcaactaccccctcctcggactgctcctgctccagcggcacggcaagaccttcaccaccgccgacgtggcccgcctctggctcgacgagctgcccgccgggcggaccttcaccgccgagcgcgtcgcctaccgcaatctcctcctcggcctggagccgcccgtcaccgccacccaccacaaccccttccgcgagtggatcggcgccctcatccgcgccgacgtccacggctggaccaacccgggcgacccggccgccgccgcggcccaggcctaccgggacgccgccctgacccacaccggcaacggcgtctacgccgccctcttcatcgccgccgccaccgccaccgccgccaccggccggacggacgtccacaccgcgctgcggaccgggctggccttcgtaccgccccgctcccgcctcgccgaggccgtccgcttcgggatccggacggccggccgggagagcgacttcgacctcgtcgtcgaccggctgcacgcccgctacgggcactaccactgggtccacgccgtccccaacaccgcgctgatcgccgccgccctcacccacgcggacggggacttcacccgctccgtctgccgcgccgtgtccggcggctgggacaccgactccaacggggccaccgccggcgccctcgccggtctgctcgccggctccccggagggcatcgggcaccgctggaccgcgcccctcaagaaccgtctcgccaccaccgtccccggcttcgacggcatcggcttcgacaccctcgcccacctcaccgcacaggaggcagcacgctcatgacggccatcgccgtgctcggcagtacgaacatggacctcgtcgcctacgtccccaaggccccccgcctcggggagaccgtcaccggccgggccttccgcacggtccccggcggcaagggcgccaaccaggccgtcgccgcggcccgcgccggcggggaggtggtgatgatcggcgcggtcggggccgacgagttcggcgtacggctgcgctccgcgctcaccgcggcccgggtcgacaccgcggccctgcggaccgtcgagggcgccagcggcaccgcccacatcacggtggacgacgagggcggcaacagcatcatcgtcatccccggcgcgaacgccgccgtcaccggtctggaggcgggtgacgaggcacggatcgccgccgccggtgccctcctcctccagctcgaactgccgctgtccgccgtcctcgccggggcccgcgccgcccgcgcgcacggcgtccgcacggtgctcaccccggcacccgcccggccgctgcccgccgatctgctcgccgccaccgacctcctcgtccccaacgagcacgaggcggccgccctcaccgggctcaccgaccccctgcaggccgccgaggccctgctggccgacgtgcccgaggtggtggtcacgctcggcgcggcgggggtgctgtacgccgcccgcggccgggagccgctgacggtgcccgcgccccgggtgcgggccatggacacgaccgccgccggggacaccttcgtcggcgccctcgccgtggccctgggtgagggccggccgatgcccgaggccctgcgctgggcctcggcggcggcggcgctctccgtccagcgcccgggagcccaggactcgatgccgacccgcgcggagaccgacgccttcgccgcggcgcagcgcggagccgcctcgtgacctccgacgggcgccggcccgcgagctgctccggcggggccgggagtgtgtcggggcgatccccgcagggcgcggaacgcaccaccgccgcgctttccggccccgggcaccgttcggcgcccgaggagacgccccggcgcgcgcccggccccaccgaagccaccgccaccgcccccgcccccgccgaagcccggccagggcaagggccactggaagggctccgcgtgctcgacctggccaccctcttcgccgggccgctggccgccaccctgctgggcgacttcggcgccgaggtcgtcaaggtcgagcaccccggccgccccgacccctcgcgcggccacggccccgccaaggacggcatcggcctgtggtggaagctcctcggccggaacaaacggacgatgaccctcgacctgtccacgccgggcggccgggacaccctgctgcgcctcgccgccaccgccgacgtggtcatcgagaacttccgccccggcacgctggagaagtgggggctgggctggcccgagctgtccgccgccaacccgcgcctggtgctcgcgcgcgtcacggccttcggccagtacggcccgtacgcccaccggccgggcttcggcaccctcgccgaggcgatgagcgggttcgcctcgatcaccggggagccggagggtccgccgacgctgccgcctttcgggctcgccgactcgatcgccgcgctgacctgcgcgtacgccgtgatgacggccctcgccggccgcgaccgtaccgggcacggccaggtagtggacctggcgatcgtcgagccgatcctcaccgtcctcggcccgcacccgctctggtacgaccagctcggctacgtccagccgcgcaccggcaaccgctccgcgaacaacgccccccgcaacacctaccgcagcgccgacggccgctggctggcggtctccgcctccgcgcagtccatcgccgaacgggtcgtgcggctggtgggccggcccgagctgatcgccgagccctggttcgcgaccggcgccgggcgggcccggcacgcggatgtactggacgacgcggtcggcggctggatcgcccggcacaaggccgaggaggtcgtcgccgcgttcgaggacgccgaggcggccgtcgcccaggtctacgacgtccgggacgtgatggccgacccgcagttcgccgccctcgacaccgtcaccgaggtcgaggacccggagctgggcccgctccgcatgcagaacatcctcttccggctctccgagacccccggcgggatccgctgggcgggccgcccgcacggcgcggacaccgacgaggtcctgaccgagctcggactgaccgggtccgagatcaccgcactgcggaccgagggagccctgtgatcctgacctggctgtacgcgcccggagaccgcccggaggtggtcgccaaggccctcggctgcggggcggacgccgtcatcgtcgacctggaggacgcggtaccggcctcacggaaggagtacgcccgcgccgcgaccgccgagctgctggccgaacggcccccgctccccgtccacgtccgcgtgaacgccctggactccccctggggcggcgccgacctcaccgcgctcggcggtctgcacggcctcgcggggctgcggctgcccaagatcagcgccccggggcagatcacggccgtcgccgaccgcaccggcggggtcagcctgcacgccctgctcgaatcggccgtgggcgtggagcgcgcctacgagatcgcccgcgcgcaccccgccctgcgcgggctctccctcggcgaggcggacctgcgggccgacctggccgtcagcgcggagacgggcctggactggtgccgctcccgggtggtggtcgcggcccgggcggcggggctggctcccccggcgcagtcggtgttcccggacatccgggacctggagtcgctggccgtctcgtgcgcccggggccgcgccctggggttcctcggccgggcggcgatccatccgcgccagctccaggtgatcgagcgggcctacctcccggcgcccgaggaggtcagctccgccgtggaggtgctgagcgccgcccgggccaccccgggtgcgctggctctgcccgacggccggttcgtggatccggcggtggtggccgcggcgcaccgcaccctggccctcgccgcgcgcatggcggcccgctgaccccggccgccgtatcccagggctccgccccggaccccgcgcctcaaacgccggcggggccggatgcggcgaacgcgaaggggggtgccgcagtgtatgcggcaccccccttcacggagcggtcaggtcagcgcttgcccggctccggggcttcggcttcggcctcggccttggcgggggcgtccttcgtgaggacgggcgtcttggcctcggcgggctcgggcttctcggcgtcagcggccccggtggcggcgtccgcgtcggccggagccgcgtcggcaccgtccttgccgccggaggtgtccggctcgacgaccgtctcacggcccggccgcagcttcgccgacagcaccaggtagacgaccgcgagcacgaagacgacgatcgaggtccagacgttcagccggacgcccaggatgtggtgcgcctcgtcgacgcgcatgtactcgatccagccccggccgacgcagtacgcggcgacgtacagggcgaaggcccgtccgtggccgagcttgaagcggcggtcggcccagatcaccaggaacgcgacgccgacgcaccacagcgactcgtacaggaaggtcgggtggtaggtcccggcgtcccggttcgggcccgcggtgatctccaccgcccacggcagatcggtggcccggccgtacagctcctggttgaaccagttgccccagcgcccgcaggcctgggccagcgcgatacccggggccagggcgtccgcccaggccggcagcgggatcccgcgcaggcggcagccgatccaggcacccaccgcgccgagcgcgatggcgccccagatgccgagtccgccctcccagatcttgaaggcgtcgacccagtcccggccctcgccgaagtaaagctggtagtcggtgatcacgtggtagaggcgaccaccgaccaggccgaagggcacggcccacacggcgatgtccgcgaccgtgcccggctttccgccgcgcgcgatccaccgcttgttgccgagccagacggcgacgaagacgccgatgatgatgcagaacgcgtagccgcggagcgggatcggtccgagatggatcacgccggtcgacggactggggatgtaagcaatgtccatggcagacatgacgctaccctgccgggcggtgcgcaccgcaacccacccggcaggacgaaaccaaatccagacctggaacgggccgtgatcagtctcccgaggagccgttcgaggtgccggtcgaggtgccgccggaccgggtggacgatccggtggacgagccggatgaaccggacgaaccggagcccgtccgcgacgcggacgacgaggccttggccccgttcttccccccggatccgggcgtcgggctggcggacggtgccggcttcacgaccccggccgcggcttccacctgctccttcagcttctgcggggtcacctggttggcctggtcggaaaggatgtccttgccgttcagaagcacggtcggggtgccgcggaactgtccggcggtgaaggcgccgtccgacttggtcacccagctgttgtgcgtgccgtcctcgacgcacgagcggaacgcgggggtgtccagcccgtcgaccttgcccgccagttccagcagcttggcgtccttgccgaaggcgtcgtcgacctcctgcggctggttctggaagaggaggtcgtggtactcggtgaacttgccggcgtcctgcgcgcaggcggccgcgttggccgccttcagcgagccgctgccgcccatcctccggtcgatgagcgtgaccaggtggtagtcgaccttgagcagccccttggcctccaggtcgtggatgacgtcgcggtagttgtcctcgaagaacttgcaggaggggcagcggaagtcctcccacacggtgagggaggacttcgcctcgggcttgcccacctggatggcgagggcgtcctttccggtggccccggaaggggcgaccacggggcccgccttggcggagccgctcttgccggtgttggccgcgatcacgcccacgacggtcgccaggccgaggacgccgaccaccgccgccgccacgacgagggtccgccgtcgcttgtcccgggtcttctgccgctcgcgctccacgaggagtcgttcccgggccgatcgtttcgtcgcatcgcggttcgcaccgtcgttcttctcgctcacgctccgccaaacgaagcagggaggcactcgcgtgcctccctgcccgcacttccacccgatcgggctacagaacccgatcagacatccgtgcctgtgatcgaacgggcgtcagctccggcgtacgccccgcgcgagctcgcccgcgagcgcccgtacggcgtccagtccggccggcaggtccggcgcgtccaggagcagcttcacgaaggccgagccgacgatcacgccgtcggcgaagcccgcgacctccttggcctgggcggcgttggagacgccgaggccgacgcagaccggcaggtcgctggtggcgcgggtgcgccgcaccaggtccgcggcctggttgccgacggactcgcgggttccggtgactcccatgagggaggcggcgtagacgaagccggagccggccgccgtgatggtggccaggcgggcgtccttgctgctgggagccacgacgaagacggtcgccagaccgtgcttctccgcgtgctcgcgccacagcgcggactcctggaccggcaggtcgggcaggatgcagccggcgccgcccgcggccgccagctcggccgtgaaccgctcgacgccgtagcggtcgatggggttccagtaggtcatcaccaggatcggggcgccggtcgcctcgtgggcctcgcggaccgtgcggagcacgtcggcgatcttgacgccgccccgcagggcgatgtcgtcggcggtctggatgaccggcccgtcgaggaccgggtcgctgtgcggcaggccgatctcgacgacgtccgcgcctccggcgatgacggccttgaccgcctcgatgccgccgtcgacggtcgggaagcccgcggggaggtaggcgacgagggccgcgcggtcctcggacttcgccttggcgagggtggcgctcagcagctcgatgttgccgcgcccgtgcgtggagctcacttgtcgtccccctcggagaactcgttgtcggcgacttcaccgtcggtgtcgtacagcccgaagtagcgggcggccgtgtccatgtccttgtcgccgcgaccggacaggttgacgacgatcaggccgtccttgcccagctcgcggcccaggtccagggcaccggcgagggcgtgcgccgactcgatcgccgggatgatcccctcggtgcgcgagagcaggcgcagggcctgcatcgccgcgtcgtcggtgaccgcgcggtactcgccgcggccggagtccttgaggtaggagtgctccgggccgatgcccgggtagtccaggccggccgagatggagtacggctcggtgatctggccctcctcgtcctggaggacgtaggagcgggagccgtgcaggatcccgggctcgcccgcggtcagcgtggccgcgtgctcgccggtctcgacgccgtgcccggcgggctcgaagccgaccaggcggacgtcggtgtccgggatgaaggcgtggaagaggccgatggcgttggagccgccgccgacgcaggccgcgacggcgtcgggcagccggccggcgcgctccaggatctggcggcgggcctcgactccgatgacccggtggaagtcgcggaccatggccgggaaggggtgcgggccggcgaccgtaccgaagaggtagtgggtgcggtccacgttggcgacccagtcgcggaacgcctcgttgatcgcgtccttgagggtgcgcgagccggacttcacggcgatgacctcggcgcccagcatgcgcatgcgggcgacgttgagggcctggcgctgggtgtcgatctcgcccatgtagatggtgcagtcgaggccgaagagcgcgcaggcggtggcggtggccacgccgtgctgtccggcgccggtctcggcgatgacgcgggtcttgcccatgcgcttggtgagcagcgcctggcccagcacgttgttgatcttgtgcgagccggtgtggttgaggtcctcgcgcttgaggaagacccgggcgccgccggcgtgctcggcgaagcggggcacctcggtgagggcgctcgggcggccggtgtagttgaccatgaggtcgttgagctcggccgcgaaggccgggtcgcccttggccttctcgtactcgacggcgacctcgtccacggcggcgacgagcgcctccgggatgaacttgccgccgaagtcgccgaagtaaccctcggcgttggggacgtgaccctccgggtccggaatgaagaactcgctggacatgtccagtgctcctacgggtgcgagatgcggcggggtggattcaccgtattgcgccgcccgcgcgtaccgcgcacaccccgctgggggatgtcgcgcgtacggtgcggagcggcccgcgtccggagccggcggcccgggacgtcaggccgtacgggagctgcccgcggcgcggtacgtctcgcgtaccgggccgctgcggccctcgttacagcgcgcctccgcggcgccatcgcatgccgttgacctgaccgggctcggagccgatcacgtaccggacccgccgcccgtggacgcgccgggccggggcgcggcagccgcgagggcggcagccgcgcgccaggggcgcgtgcgccgtcggcacggcgaccgggcgggagcccggccgggtgcggacggaggagcggtcgtgggccatgggtgcgggtcagctccgcccgtggcgcagtgcggggtgggcgcctgcggcgacgaggtcggccacggccgccttcgggtcgcggccggtcaccagcgactccccgacgaggacggcgtcggcgccctcgttggcgtaggcgatcaggtcgtgcgggccacggatgccggactcggcgatcttgacgatgtggtccgggatctcgccgacgacgcgctcgaaggtggagcggtcgaccttgaggtccttgaggttgcgggcgttgacgccgatgatcttggcgcccgcggcgaccgcgcgctccacttcctcctcgtcgtggacctcgacgagcggggtgagaccgatggactcggcccgctcgatgagggagacgagggcctcctgctccagggccgcgacgatcagcaggacgaggtcggcgccgtaggcccgggcctcccagagctggtacgccgtgacgatgaagtccttgcgcaggatcgggatgtccacgcgggcgcggacggcctccaggtcggccagcgagccgccgaatcggcgctgctcggtgaggacggagatgaccgccgcaccgccagcctcgtagtcggcggcgagcccggccggatcggcgatggcggccagcgcgcccttggacgggctggagcgcttgacctcgcagatcaccttgacgctgtcgccgcgcagggcagcgacgccgtccttggcctggggcgccttggcggcacgctccttgagctcgtcgaggctcacgcgggcctgccgttcggcaaggtcttcgcggaccccttcgatgatctcgtcgagcacactcacgcgagcggcccccttccgggtcgatgacggtcggccgccttgcagacacgtacaaccgcaaggtcggctctcaaatggtatccgcaggaggcgtcgccctccgcacgcggttgacgtcgtcccagtaactggacattcggaatccgtgcgtcatagggcctgcccagggggctcagggcgccagtgcggagccgaaggagagatttcggacaatgacgaaaaccagggccagcgcaccgattgcccaccagtaccggcgccgcaggacgatcctcggggtcggcccgccgcggaacgcgcggaccagccacagggccatgaaccccgcgaagacgaagtagcccacgaccgcgagcgcgttcgccccgagagcggtgaccagatcgccgtgcgcgaaggcgtgcgcgctgcgcaggccgccgcagcccgggcacaggacgcccgtcagccggaacagcgggcacacggggtagtggccgggctcgttgggatccaccgcgcctacgtacgcgaacgcggcggtgactccggccaggtagaacgccgggacggcgaggcgcatggcccgggacggggacgccggcccgggctgccccggccccgcgggcacgggcgtcggcgacggcggggcatcgggggtgcgaaaggcgtccacctgctgattctctccgctcatgacaaaaggcgcagcccggcggggccgcgcctttcggccgcgtcgctcgtgcgctcagaccttggcgggaaccttggacgcggcgatgacctcggcgaggtccttgtgcgcggccttcggcgcgcccatgcccgcggccttcatccccaggccgacgacaccgccgagcgcgacgacgacgagtccggcccagaagccgagcgggttcgcgagcaccatgaaggcgccggagatgcagaaaccgatgaaggcgatgatgacaccggtccaggcggccggggtgtgtccgtggctagtgcccgccatgagttgctcctcgttgctctgtcgcgctgctgtgtcgaacgtgcggtctgtgtcgaacgctcggcgaccattgtcccgcaccgggcggcttcgccgtccaggggggtcgggtcagtgggcccggtcggcgcccgggtcgccggtcgggtcctcgccgcggtccagagccttccacagatcctccggccggtccggatcaaccgccgcgacagtccgggcgcgcgggctgccgtcacgctcgtagcggccccccatcgagggccagctccggccgaaacgcagcgccagcagcccggcgacgaggatcagggccgcgccggcggccgtgacgtagggccaggacgtctgggtcaggccggccacgtgcgcggcgctgtccgcggtcgtacgggcggcctgcgcgtccagggcacggcggccgtcggagccgaggagggcggacagcaccgcccccaggccgctgagcgccagcagccccgacaccagcagccggcccttgccgcgtacggcgaagacggcgaccagcgcggcgaggcccacgatggccagcgcggcgggcaggccggtgacggcccgcccgtcggcggccagctggagcgagtcgctgccgatggcggcggtgcccctggcccaggtccggccggaggcgagcaggacgacggtggcgccgagggcgccgagcagcagggcgacggccacactgcggcggccgctgcgacggtcgggagcctcgggctcggactcggcgtcggcgtcgtttcggggcgggggtacggcactcacgtaccccactatcccctacgccctcaggagccgtggaggcggttcgccgctcccaccgcgcgcagcaccgcggccgccttgttgcggcactcgttgtcctccagctcgggcaccgagtccgcgacgacaccggccccggcctgcacgtacgccgtgccgtcgcgcagcagcgccgtgcggatggcgatggccgtgtcggagtccccggcgaagtccaggtagcccacgcagccgccgtagaggccgcgacgggagggctccagctcctcgatgatctgcatggcgcggggcttgggcgcgccggagagcgtaccggccgggaaacaggcggtgagcacgtcgaaggcggtcttcccctcggcgacgcgccccgtcacggtggagacgatgtgcatgacgtgggagtagcgctcgatcgacatgaagtcgacgacctccaccgatcccggctcgcagacccggccgaggtcgttgcggcccaggtcgacgagcatcaggtgctcggcgcgctccttggggtcggccatcagctcgtcggcgaggtcgttgtcctcctgcggggtcgtgccgcggtggcgggtgccggcgatggggtggaccatggcccgcccgtcctcgaccttgaccagcgcctcggggctggagccgaccacgtcgaagccgttctcgaagcggaagaggtacatgtacggggacgggttggtggcccgcagcacccggtagacgtccagcgcggaggcgtggcagggggtctcgaaccgctgcgagggcaccacctggaaggcctcgccggcccggatgcgctccttgatgtcctcgacggccgcctggtacttctcgccgccccacagggcggagaactcgggcagctcggaggcgggcagcgcggccggcacgtagggggcgggccgtgcgaggtcggcctccatcgcgtcgaggcgggcgacggcgtccgcgtacgcctcgtcgaccccggagtcgaggtcgttgtggttgatcgcgttggcgatgagctggacggtgccgtcccagtggtccatgaccgccaggtcggaggtgagcagcatggtcagctcgggcagctccaggtcgtcggcggtgtgctcgccgatgcgctccaggcggcgcacgatgtcgtagccgaggtagccgaccatgccgccggtgaagggcggcatgctgcccgcgaggtcgcggggggtgtgcagggcctcgacggtggcgcgcagggcgtcgagggggtcgccgtcggtgggtacgccgacgggcggggtgccgatccagtgcgcccggccgtcccgggcggtcagggtggcgtcgctgcggacccctacgaaggagtaccgggaccaggagcggccgttctcggcggactccaggaggaaggtgccggggcgttcggctgccagcttgcggtagagcccgacgggggtgtccccgtcggccagcagcttgcggctcacggggatgacgcggcggtcggccgcgagcttgcggaacgtctcaagatccatttcgagggaccctacctagtcggctgcgcggaggaggacatcttcgtcgaagcaggtgcgtgccccggtgtggcaggccgccccgacctggtcgacccggacgagcacggtgtcggcgtcgcagtcgagcgcgacggacttcacgtgctggaagtgaccggacgtgtcccccttcacccagtactcctggcggctgcgggaccagtaggtgcagcggccggtggtcagggtgcggtgcagggcctcgtcgtccatccagccgagcatgagcacctcaccggtgtcgtactgctgggcgatggccgggatcagcccgtccgcggaacgcttgaggcgctcggcgatggcggggtcgagactgccggggcggggggacgtactcatggggacattgtgccgggccgggacgggggtgatgatccccgtccgcctgatgagcgggtgctcggcgggttcccgccgtaggctggcccgcatgtctacccatgcgaagcgtgaacgcctgctcctggcggacctgttggaggcggccggtccggaggcccccacgctgtgctccggctggacctgtcgcgacctggccgcgcacgtggtggtccgtgagcggcggcccgacgcggcgggcggcctgctgctgaacgtgctgaaggcccgcctggacaaggcgatggaggagtacacggccaagccgtacgaggaactgctccagctgatcaggaccggcccgccgaggatgtcggtgtacgcgctgaagcagatcgacgaggcggcgaacgcggtcgagttctacgtccacgccgaggacgtccgccgggcgcagccggactggtccccgcgggagctggacccggtgttctccgacgcgctgtggtcgcggctggagaagctggcgcggctgacgggccggcgctcgccggtgggcctggtgctgaggcgtcccgacgggcggacggtggtggcccgcaagggcgcgccggtggtcacggtgacaggcgagccgggggaactgacgctgttctgcttcggccgtcaggcggcggcgtcggtgacgctggacggcgagaaggaggccgtcgccaagctgacggtggcgtccctgggcatctgacccgggtgcggtcctgttccgggtgcggcccggtggccgcgcctcaatcgccggcggggctgggtttggctccgggtgggcggggtcgggtccgggggtgggggtgcggggccgccggcgggtgtctcctcggctcgcgcctgcgggcacgtcccggccgtgcggggtggttgcgcgctcgtcctgcggggacaccccccgccgtccccgcacccccacccgggcgatccacccgggggccgtggggtggggacactccgggggctccccgcaggacgagcgcgcaacccgggccgaacggcagaaccacggccgcaggcgcgagccgaggagagcccccggaggggcaccaccccacccgaagccaaacccagccccgccggcgtttgaggcgcgtccaccgggccgcacccggaaacgggacccgcaccgcccggccagggcaacggcggccaccgggccgcacccggaacagggggcagcgccccgaaacggcagaccgcgccggaggcgaagggtcagcggacggggtggcccgcttcgcggagggccgttttgacctccgagatgcgcaggtcgccgaagtggaagaccgacgccgccagcaccgcgtcggcaccggcgtcgatcgccggggcgaaatcggccaggcggcccgcgccgcccgaggcgatcaccgggacggtgacgtgcttgcggaccgccgcgatcatctcgacgtcgtagccgtccttcgtgccgtccgcgtccatggagttcagcaggatctcgcccgcgcccagttcggccgcccggtgcgcccactcgaccgcgtcgatgccggtgccctgccggccgccgtgcgtggtgacctcgaaggtcccggcggcggtgcggcgggcgtcgaccgacaggacgagtacctgccgcccgaagcgctccgcgatctcctggatgagctcggggcggacgatggccgcggtgttcacgccgaccttgtccgctcccgcgcgcaggagtttgtcgacgtcgtcggccgtccggacgccgccgcccaccgtgagcgggatgaagacctgttcggcggtgcggcgcaccacgtcgtacgtggtctcgcggttcccggaggacgcggtgatgtcgaggaaggtcagctcgtcggcgccttcggcgtcgtacagcttggccatctccaccgggtcacccgcgtcgcgcaggttctggaagttgacgcccttgacgacccggccgttgtccacgtccaggcaggggatcacgcgtacggcgagggtcatcgggccaccgccctgaacgcctcgacctccacctcgacgaccatgccggggtcgacgaagccggagacgatgagcatggtcgcggcgggccggaccgtgtcgaagagctgcttgtgggcgcggccgacctcgtcgacgtcccgggcgtgcgtgaggtacatgcgggtgcggaccacgtcctcgggtcccaggccggcctcggcgagcgccttgaacgcgacctcgaaggccttgaccgtctggtcgtacgggccgcccgcgtcggcggcggtgcagccggagaccaggaccaggccgttggcgagggccacggcgcgcgagtagccgatgacgtcctcgtaggcgccgccggaggagatgcgccgtacgtcggccgtggagtcgggggagttgctcatgcggagaccaccttcagggcttcttccagggtgaaggccttggcgtacagggccttgccgacgatggcgccctcgacgcccagcgggaccaggtcggacagcgcccgcaggtcgtcgagcgaggagatgccgccggaggcgacgacgggccggtcggtggcggcgcagacgttcttgagcagctccaggttggggccggtcagcgtgccgtccttgccgatgtcggtgacgacgtaccgggcgcagccctcggagtccaggcgggcgagggtctcgtagaggtcgccgccctcgctggtccagccgcgtcccttgagggtggtgccgcgcacgtcgaggccgatcgcgatcctgtcgccgtgctcggcgatggccttggccgcccactcgggggtctccagggcggcggtgcccaggttgacgcgggtgcagccggtggcgagggccgcggcgagcgaggcgtcgtcgcggatgccgccggagagctcgaccttgatgtccatggcgcgggtgatctcggcgaccagggcgcggttgtcgccggtgccgaaggcggcgtcgaggtcgaccaggtgcagccattcggcgccggagcgctgccaggcgagggccgcgtccagcggggagccgtaggaggtctcgctgccggacaccccgtgcacgaggcggacggcctggccgtcgcggacgtcgaccgcgggcaggagttcgagcgtgggtgcggtcatcacagggtctcgatccagttggtgaggagctgggcgccggcgtcgccggacttctcggggtggaactgcgtggcccacagggcccggttctccaccgccgccacgaaacgctcgccgtgggtggcccaggtgaccttgggggcgcggatcagcgggttggtgatttcgaggctccagtcgcgcgccgcgtaggagtgcacgaagtagaaccgggcgtcggcgtccaggcccttgaaggcctggctgtcggccggggcctcgacggtgttccagcccatgtgggggacgatcggggccttgagcgggccgacggtgccgggccactcgtccaggccctcggtctcgacgccgtgctcgatgccgcgctcgaagaggatctgcatgccgacgcagatgcccatgaccgggcggccgccggagaggcggcggccgatgatccagtcgccgcgggcctccttgaggccctgcatgcaggcggagaaggcgccgacgccggggaccaggagcccgtcggcgtccatggccttgtcgtagtcgcgggtgatctcgacgttcgcgccgacacgggcgagggcccgctcggcggagcggacgtttccgaagccatagtcgaagacgacgacgttcttggtggggcggactgcgctcattcccaaattccctggattcgcaggactcctgcggcgaggcacatcgcggaggcgagggccagcaggatgatgaccgacttgggcatcttctgcttctggaaggagtagacgcccccggccaggaacaggccgaggacgatcaggatggtgttcaggccgttcacggctagagggcgcccttcgtggagggcaggatgccggccgcgcgggggtcgaactcggcggcgtagcgcagggcccgcgcgagggccttgaactggcactccacgatgtggtgggcgttgcggccgtacgggacgtggatgtgcagggcgatctgggcctgcgcgacgaaggactcgaagatgtgccgggtcatcgtcgtgtcgtacgtgccgatcatcggcgccatgttctcgggctcggtgtgcacgaggtaggggcggccggacaggtcgacggtcacctgggcgagggactcgtcgagcggcacggtgcagttgccgaagcggtagatgccgaccttgtcgccgagggcctgcttgaaggcggcgccgagggcgagcgcgctgtcctcgatggtgtggtggctgtcgatgtgcaggtcgccctcggtcttgacggtgaggtcgaagaggccgtggcggccgagctggtcgagcatgtggtcgtagaagcccacgcccgtcgagacgtcgacctggccggtgccgtcgaggtttatctcgacgacgaccgaggtctccttggtggtccgttcgacccgtccgatgcggctcatgcgtgctgctccttcttcagtgcgcgaaccgcttccaggaacgcgtcgttctccgccggggtgcccgcggtgacccgcagccatcccggtacgccgttgtcccggaccaggacgccctggtcgaggatcttctgccaggcggtgtgcgagtcctcgaacttcccgaactggatgaagttcgcgtcggaatcggtgacctcgaagccgatggcccgcagtgcggcgaccaggcggtcgcgctcggccttgagctgctcgacgtagccgagcagggtgtcggtgtgctccagtgcggccagtgcggtggcctgggtgacggcggacaggtggtacggcaggcgcaccagctggacggcgtcgacgacggcggggtgcgccgccaggtagccgaggcgcaggcctgccgcgccgaaggccttggacatggtccgggagatcaccatgttcgggcggccctcgatgaggggcagcagcgagtcccggtggctgaactccacgtaggcctcgtcgacgatgacgagagagggcttggcggcctgcgcggcctcgtagagggcgaggaccgtctcggcctcgaccgcggtgcccgtggggttgttgggcgaggtgatgaagacgacgtcgggggcgttctcggtgatcgcctgctccgccgcctccacgtcgaggcggaagtcctcgcggcgcggcccggagatccagccggtgccggtgccgcgggagatcagcgcgtgcatcgagtaggagggttcgaaaccgagcgcggtgcggccgggcccgccgaaggtctgcagcagctgctggatgacctcgttggagccgttggcggcccatacgttctcccgcgccaccgggtgcttgccggtacgggtgaggtaggcggccagctcggtgcgcagctcgaccgcgtcccggtcggggtagcggttgagggtgcgggccgcttcggcgacgcgctcggcgatgcgcgcgacgagctcgtcgggcagctcgtaggggttctcgttggtgttcagctggacgggcacgtcgagctgcggggcgccgtacgggctcttgccacgcagttcgtcccggatgggcaggtcgtcgatgccgatgctcactgggtggggaccttccatccgaagcgtgccttgagggcagcgccgtgggcgggcaggtcctcggcctcggcgagggtcaccacgtggtgggtgacctcggcgagggcgtcgcgggtgtagtcgacgatgtggatgccgcgcaggaaggactgcacggacaggccggaggagtggcaggcgcagccgccggtgggcaggacgtggttcgagccggcgcagtagtcgccgagggagaccggggcccacgggccgacgaagatcgcgccggcgttgcgtacgcgggcggcccaggcggcggcgtcggcggtctggatctccaggtgctcggcgccgtaggcgtcgacgaccttgaggccgtcctccaggctgtcgaccaggacgatcgcggactgcttgccggcgagggcgggcttgatccggtcctcgacgtgcttggtcgcggcgacctgcggctccagctccttctcgacggcgtccgcgagctccgcggagtccgtgacgaggacggcggcggcgagcgggtcgtgctcggcctggctgatcaggtcggcggcgacgtgcaccgggtcggccgtggagtcggcgaggacggcgatctcggtcgggccggcctcggtgtcgatgccgatcttcccggtgaagtagcgcttggcggcggcgacccagacgttgccggggccggtcaccatgttggcgggggcgcactcctcggtgccgtacgcgaacatcgccacggcctgcgcaccgcccgccgcgtacacctcgtccacgccgagcagcgcgcacgcggcgaggatcgtggggtgcggaaggccctcgaactccttctgcggcggggacgcgagcgcgatcgactcgacgcccgcctcctgggccggtacgacgttcatgacgacggaggacgggtagaccgagcggcctccgggggcgtacagccccacgcgctccaccggaacccacttctcggtcacggtgccgccggggaccacctgggtggtgtgctcggtgcggcgctggttccggtgcacgatccgggcgcgccggatcgactcctccagggcggcgcggaccgccgggtccagctgctccagggcggccttgatggcctccgcgggtacccggacctgcgagagttcgaccccgtcgaacttcttcgcgtactcgatcagcgccgccgtgccacgatgatggacgtcctcgcagatgggccgcaccttctccagggcagcttctacgtcgaactcggcacggggcagcagatcgcgcagggcgccgccctcggggagggcgtcaccgcgcaggtcgatacgagagatcacctcacaattctctcagaccgcttcgcgccaccgtccgcccgtatcactggctgatacaggccccggatgtcacagccgcccgttagcgttcccggtacacggggatgacagcggaggggggccgccgtgaccgaggcgcgcacggacggggaaccggcggatctcaccgctgccgaacgccgcatgtgggacgcgttccgcacgggcagcatctgcgatctcagcacgcgcgccgccgaccgggacgacccgcacggcgagcacgtctgggggcccgagcgcagcgtccgcgcgcgggtggtggcccggctgctgctgcacgggccgccgccggtgccgggccgggtggcctcgctgaagctgcgcggggtgcggatcagcgggcggctggaactgtccggcggcgcggtggccccgtacgtggagctccagtcctgccgcttcgacagcgagatccagctgtccgaggcccgtttcggcacgctgcgcctgatcaactgcgcgataccgcggctggaggccgcccggctgcacaccgagggcgatctgcacctgccgcgctgccgggtggcgcgcgggatccggctcaccgacgcgcagatcggtaccgacctgctggtcagtcaggcggtggtgcagcgggacaacaagggccgggcgatcgccgcggacgggatgtcggtcgcgcaggacttccaggcggagctgctggagacgtacggggaggtgagcctgcgcggcgccaaagtgggcgtgtcgatgaacctgcggggggcccgcctgcgcaacccgtacgggcggtacgcgctgaacgccccgcagctgaccgtcgagcggaccctgtacctgacctccatcgcgctggactacgcggcggcgggcgggggctcctccactcccccgtacgggctgggggcgacgcccacgcgcggtcagcgggcccagcgcttcgagtgccggggcgggctgcggctggacgacggccggttcggggacgcgatcgacttctacggcgcccggttcacactcgccgccgagcaggagatatccctgcgccggattcagacgccggagttccgtttcgtcggcgagcggccggagctcgggcgggtggtggtgtccggggccaaggtggtcaagctcgtcgacacctcgacgagctggccgggcccgggcggggtgtccatcgaggggttcgtctacgagaacctcgcgccccggggtcatttcccgctctcccgccgcctggagtgggtggaggcggccacgcccgagtactcgccggagccgtacgagcggctggccgccgtactgcgggccagcggcgaggaccaggacgcccgcgaggtgctgctggccaagcagcggcggcgccgggccacgctgacaccggggccgaaggcgtgggggtacctccaggactggacggtggtctacggctaccggccgggccgggccgcgctgtggatggcggtgctgtgggcggcggggacgctgctgttctcccagctgcacccgccggcgatcaaggaggacgagcatccgcagtggagtgccgccctgtacgcgctggacctgctgctgccggtgatcgacctcggccagcagggccagtggaagctggagggcggctggcagtggggggcggccgggctcgtcatcatgggctggatcctggcgacgacggtggcggcgggcgcctcgcggctgctgcggcgcgggtgacggcggcgggggcgcccggtgggcggcgcgcggtgggcggcgcgcccgccgccgtccgcccctcaaacgccggacaccctcggtggcccgggcgattaccctgtgcctcgtgaccaccgttcgcctgccactcttcccgctgaactcggtgctgttcccgggactcgtcatcccgctgaacatcttcgaggagcgttatcgcgccatgatgcgcgagctgctgaagacggccgaggacgagccgcgccgtttcgcggtcgtcgcgatccgcgacggccgggaggtcgcgccgaccgcgcccggcctgccggaccagacggccctgcccgagcggggcccggcggcgggcttcggcccggacccgatccaggccttccaccgggtgggctgcatcgccgacgcggcgaccgtccgggagcgggaggacggcagcttcgaggtcctggcgaccggtacgacgcgggtccgcctggtctcggtcgacgcctcgggccccttcctgacggcggagctggaagagctcccggaggactcgggcgagggcgcgggtgtgctggccgagggggtgctgcgggccttccgcaactaccagaaacggctggccggagcccgcgagcggtccctgacgggtgccgagctccccgacgagccctcggtggtctcctacctggtggcagcggcggcggtgctggacatcccggcgaagcagcggctgctccaggccccggacaccgcgacccggctggcggaggagctgaagctgctgcgtacggagacggcggtgatccgccacctgccgtccctgccggcggtggacctgacccgtgccccgacgagcccgaactgagcacacaccgatggcgaagaagtccaagcaggcagcaggcaccccggcgatcgtcgccctgacggcggccggcgtcgcgttcaccacgcacgcgtacgagcacgacccggcccatccctcgtacggggaggaggcggcgcaggcgctcggggtctcgcccgcccaggtcttcaagaccctggtcgcggacgtggacggcgtgctgacggtggcggtggtcccggtgtcggggtcgctggacctcaaggcgctggcgacggcggtcggcggcaagcgggcggcgatggcggacccggccctggcggagcgcacgacgggctacgtcctcggcggcatctccccgctggggcagcgcaagcgcctgcgcacggtgatcgacgcctcggccgcggcgcaccccacggtctgctgctcggcgggccgccggggcctggagatcgaactctccccggcggacctgaccgccctcacctcggccaccgtggccccgatcgcccgcccgtagcggtaccggccggcccggcccggcccgcgctccgtgaacggtcccgggctcagctctggagatcggcctccgcggcggtgaagaactcgtcggcgacggcgcgggcacggtcaaggtcggtgagcggttctccgaggatgcgcccggccagctccgcggccagcgcgagaacgccctcgcggagctccgcctcggcgatcacccggtcggcctccagctgcacggtggccgcggcgaccatgtcctcgcgcgccttctgtccctcggcgcgaacggcggcgaggagggcggtgccctcctcgagggcggcctgacggatctgcgaggcctcgtgacgcgcggcggtcagctccgcctggtacgcggcacggacgcgctgcgcgtccagctggaccgccccggcccgctccagtgcccccgtggtggcctcttcgcgttcggcgagtgtcttgtcgatcctcggcaggaggaccttggccagcgcggcgaagaccgcgaggaaggtgatgaggcctgctatgagctcaatgacgttcggcttcaggggtcccatgatcgaatcataacggcgcgcaggcggttggattcgaacagcgacgacggaatgacttgaaatcgcctggccccagccctgtccgccgttcgacgaggcgggaggtccggggctgcgcgcggcagggtcaggcgcgtgggggctccggggcctgggaggccgggtcggcggacggcggggcctggtagtaacccgaccactcgaacaccggcacggggtcggggtcccgcggcgaccacagcgcggtgagccccaggtgcagcagcacggcggtcatcggccaggccagcagcgccccgtgcgcgagcagctccagcggcgcgtcgaacgcgacccccttgcccgccgccttcgccgcggcgaccaggtccgacgacggccccagccacagcccgaaccgccacccgaccagcgcgccgaagacggacccgaccgcgagcccgatcaccagcggcacaccgccggcccggcgccacaggaaggtgccgacggcgctgagcacgcccagccccagcgacagcaggaagaaggtgccgtcggaggcgatccgcgcctcgctctcgctgttgtgcaggaagacggcctccccgttggagacgtactgcacccggggtgccagccacatccacagcaggccgaggagcagtccggccgcaccgacgagcagggcgacgacggccccgtcccggacgtcctccggggtgatcgccccggaggcggctcccggcttctcgggctggagcggcggcgggtcgaggggggacggcggggtcacggcttcggtcacccccacatcgtgccaggtgtgcccggcagcggcgtcggcggaccgtgtcagcggacggccgcccggcggtacgcccaggtcgcgacggtcagcgagagaaccccgacggccccgcacacgcccaggtcgaagacgacggcggcccagtccggttccggggcgaaagtgcgggcgacggcctcgacgccgtacgtggacggcagcaggtcccgggcccacacgatcacgtccggcatccgctccggcggcagcaccccgagcagcagcgccgcggacatgccgagctgccccgccagggtggccagctcctgccgcggtgccagcaggcccagcgccgcgccgagcccggccagcgcggccccggccagcggtaccaccgcggccaggatccacagcccgctcagcggcagcccgaacagcaggcatccgaagacggcggtgaccagggtcccgggcaaggtgaaggaggcgtacgcggcggccgcgcccagtaccaccgacgcgggcggcacgggcagggtggcgtagtggtcgagcccgccgccggcccgcagctgcccgaagtactgggcgagcaggttcagggcgacgaaggcgacgacgagcaccgaggagccggcgacgacggcgcgggcctccgaccccccgtcgaccacgccccgcatcaggatcatgatcccgacggactggaaggtggcgacgaacagcagcgggatccgggccacccgggcccgggacagctgggcccggtagacggcggccagggaggggaagaaccgagctccgggcgccagcggcgcggccgcgagtgcgggagcgggtacgtcctcgggcgcgagcgcggcccggacggcccccgtcgagcggtcgctcacgacttcaccagccctttcgtcttgccaccgagggccaggtacacgtcttccaggctgggggtcgccagggtgaagtcgtcgagcgcggcgaaggccgggctcccggtgaccgaggccacggccgccctcgcctcgtcgggtgccagccggagcacccagcggcgccccgactcgacggcccggtcccgcagccgtgcgacctccggcacctccagcggagcgccttcgcgccacaccagctccagccggacctcgcccgagacggtggacttcagtccggccggggtgtcgcaggcgatgaccttgccctggtcgatgacggcgacccggtccaggacggtctcggcctcgatgacgttgtgggtgacgagcaggacggtgacgccgtgccgcgcgcgccgccggtcgacggcggcccacacggcccgccgggcgaccgggtccatgccggtggtgggctcgtcgaggaccaggacgggccgctcccccaccagcgcggtggcgaagcaggccaggcggcgctggccgccggagagtttcttcaggggccgcccggcgatctgggtcagtccgagctcgtccagtacggcgtcccgcgcggcccgggccgcgcggacgtcgagcccgcgcagccgtccggtggtctcggcggccagggccacggtgagctcgtccagggcggtggactcctggcccaggtaggcgagcagccgggaggcgcgccgggggtggcgtacgaggtcgtggccgagcagggccaccgagccggagtcgggccgcatcaggccggtgagctggcggacgagggtggacttgccggcgccgttggggccgagcaggccgaagatctcgccgcgccggacgtcgagggagaccccgtcgttggcgcgggtctcgggcagggcgggggccccgcgccggccgcgtaccgcgggatacgtcttgaccaggtcacgcaccgcgcagatgacgtccgacgccgctcccgcggccgccgccgtgctgttccccgcctgtgctgtgcccgtactcacgagggagcagcctacggggttcccggccctactcggccgtcggggtcagcggggcgccggcgtcgccggaggccgccgcgggcgcggaggcgggtacggcggccacgtgttcggcggcggcgcggacgtcgatctcccgccagaacccggcccggatggcgtaccggtcgtgctcgtcgatctggtcgtccttgtgcgccagcagtccgaaccgggcggcgtagcgcagcagttcgccgtcgatccggtgcgggatccgcgggtacatggtggccagcttctgcaggtgcacggactccgggaggcgttccatccagcgccgggcgaacacctgccccacctcgaacgggtcgccgccgacggtggtgatgtcctcctcgcggtccgcccagcgctgttcggcgctggtgagctgggcgagggtgggcagggaggccgtctcggcgggctcgcccagcggtccggcccggtcgatccagcccttgtcggaggaccagcgcagggcgctggcgggggcgtgggcgccgctcggcgcggtcgcgctctgcgggccgggggcgcgcagggcgccggccaggtccttgggggtggggaccggtttgccgccgggggtggcgggcgccggtacggggaccccgtcccggtcctcctgcccggtggcggcggctccgttgcgggccgcctcggcgagcgccgcctcgggcagcggcgccgagaggatggcggcgatgtcggggcgcggcgcgggcggcggggagcacaggccggtgaggtccttggcgcggacggcccgggtgatccagacccggtccaggacgcggcgttcgtcggcctcggcgacgaggtcctcggactggttgtagtccccgtcggcggcctggacggcccacaggtggacggcgacgccgtgttccttggcggacatcaggccgggcagcaggtctccgtcgccggtgacgaggacgacgtcggagcaggcccggttgcgggcgagctcggtgagctcggcgtgcatggcggcgtcgacgcccttctgcgcccagcggccgtcgctgcgggtcagggcgccgaggcggacggtgacgcggggcatgacgcgcagccgccggtgttcgggctggggcacccggtcgggtgcgccgtcgaaccagtagatgcgcagcaggggctgttcggtgtcggcctcggcccgctcgcgcaggccctggatgagggcggcatggtcgatggtgatccgggagcgggagggctccccggcgagaaggctggcggcggcacccagcaggtagccggcgtccaccaggacgacgcagcggtccacgcgttccaccctcttccctgggggtcctctgtgcttttcggcgggttccccgagtctgcccgaccccaagggtgttgaaggccggaactcgatcatcggcgtggcggatctcacggtcggcgggacgggaggcttcggctacgcgcagtaatgatccaaaatgcgccgtttccggccttgtgtgagtgtgaaggcggtcctggcccctagaccctcacggaggttccaccatggccaagaacaagaaccagaagcagcccgccaagcagcagccccggtcggggcaggatccgaccaagggctcctcggagaccgagtcgatgccctcctcggcgccgagcccgatggacatggcgcacaagcgcaaggaaaagaagttcggccacaactgacggccgcgacggacggccacgaccgagggccgcacgcgcacgcggaagggcccgcccgagaccaccgggcgggcccttccgcgcgtaccgacgtgggtgttatccggccaggcaggacggtccgagcagcaccttgaggtcgccgaagagcgccggatccggctggacgcggtgcttgtcgaggcggagcacggtggtggtccgcggcccctggagcttgatccgtacctcggtgttgcccttgtggtggcgcaggatctcgcccagacgggtcaccatcggcggcgtgaccttgacggtggggatggtgaggaccacgggggcgttggtgccggccgaggtgaggtcggggaccatcatctccatcgcgaccagacgggggacgtcctcgcgcttgtcgaggcggcccttgacgaagaccacggtgtcctcgaccagctgggtggagacgagctggtaggtcgccgggaagaacatgcactcgatggagccggccaggtcctcgacggtggcgatggcccaggcgttgccctgcttggtcatcttgcgctggaggcccgagatgatgccgccgatggtgacgacggcgccgtcggagtgctcgccgccggtcagctgggagataccggcgtccgtcttgtcggagagcacgtgctccaggccgaagagcgggtggtcggagacgtagaggccgagcatctcgcgctcctgggcgagcaggtaggacttctcccactcgacgtcggagaactccacgtcgaggccgaagccgggctcgtcgctcgcgttctcgtcacccattccgccgaacaggtcgaactgtccctcggcctccttgcgcttgaccgcgaccacgttgtcgatcatcgactcgtggtgtgcgaccaggcccttgcgggtgtggcccatctcgtcgtaggcgccggccttgatcagcgactcgacggtgcgcttgttgcagacgacggcctcgaccttgtccaggaagtcggggaaggaggagaacttccccttggccttcctggtcctgatgatcgactcgacgacgttggtaccgacgttgcgcaccgcggtgaggccgaagaggatcacgtcgtcgccctgggccgcgaagttcggctcggactcgttcacgttcggcggcaggaccttgatgcccatccggcggcactcgttcaggtagatcgcggacttgtccttgtcgtccttgaccgaggtgagcaggccggccatgtactcggccgggaagttcgccttgaggtaggcggtccagtaggagaccaggccgtacgcggccgagtgggccttgttgaaggcgtagccggcgaaggggaccaggacgtcccagagggccttgatcgcctggtcgctgaagcccttcttcttggcgcccgcctcgaagatgacgaagttcttcgccagttcctcgggcttcttcttgcccatcacgcggcgcaggatgtcggcctcgccgagcgagtacccggcgatgatctgggcggccttctggacctgctcctggtagacgatcaggccgtaggtgaccgcgagcacctcttcgagcggcccctccagctccgggtggatcggggtgatctcctgctgcttgttcttgcgcagggcgtagttcgtgtgcgagttcatgcccatcgggcccggccggtacagggccgagacggcggagatgtcctcgaagttgtcgggcttcatcaggcgcagcagggagcgcatgggcccgccgtcgaactggaagacgccgagggtgtcaccgcggccgagcagttcgaaggtcttggggtcgtcgagcgggagggccaggagatcgatgtcgatccccttgttggccttcaccatcttgacggcgtcgtccatgatcgtgaggttgcgcaggcccaggaagtccatcttcagcaggccgagcgactcgcagctcgggtagtcccactgggtgatggtgacgccgtcggtgtgccgcacccagacgggcacgtggtcggtgatcgtctcgctggacatgatgacgccggcggcgtgcacgcccatctggcggaccaggccctccacaccgcgggcggtgtcgatgaccttcttcacgtccggctcgttctcgtacatcccgcggatctcgccggcctcgccgtagcgggggtgcgcggggtcgaggatgccggagagcgggatgcccttgccgaggacgtcggcgggcatggccttggtgagccggtcgcccatggcgtacgggtagccgaggacgcgggccgagtccttgatcgcgttcttggccttgatggtgccgtacgtgccgatcatggcgaccttgtcggcgccgtacttctcggtcacgtaccggatcacctcgacgcgccgacgctcgtcgaagtcgatgtcgacgtcgggcatggagacgcgctcggggttcaggaagcgctcgaagatcaggccgtgcgtgagcgggtcgaggtcggtgatgcccatggcgtaggcgacgatcgagccggccgcggagcctcggccagggcccaccgcgatgccctggttcttggcccacatgatgaagtcggcgacgacgaggaagtagccggggaagcccatcgagatgatcgtgtccatctcgtactcggcctgctgcatccggtcctccggaatgcctccggggtagcggcggtgcatgccgcgcatggtctcctcgcggaaccagctgacctcggtgtggccgtccgggatgtcgaacttcggcatcaggttccggaacttgaacatgccctcggtgtcgatctggtcggcgaccagccgggtgttggcgcagccctcctgccaggcgtccgaggagtcgatcgcgtacatctcgtcggtcgacttcaggtagtagccggtgccgtcgaagcggaagcggtccgggtccgagaggttcttgccggtctggatgcagagcagggcgtcgtgcgcggtggcctcgctcgcgtacgtgtagtgcgagtcgttcgtcaccagcggcgggatgccgagcttcttgccgatctccagcagcccgtcgcggacccggcgctcgatctcgatgccgtggtccatcagctccaggaagtagcgcccctcgccgaagatgtccttgtagtcggaggcggccttcacggcctcgtcgaactggccgagccgcagccgggtctgcacctcgccggacgggcagccggtggaggcgatcaggccctcggaccacttggagatggtctccttgtccatccgcggccacttcgtgagccagccctcggcgtaggcgtcggaggacagccggaagatgttgtgcaggccggtgacgttcgacgcccagatcgtcttgtgagtgtaaccgccggaaccggagacgtcgtcacgcttctggtgcggctggccccactggatgcgccgcttgttgcgccgggactcgggggcgacgtacgcctcgatgccgatgatcggcgtgatgccggccttctgcgcggtgtggaagaagtcataggcgccgtgcagattgccgtggtcggacatggcgatgtgcgtcatgcccatctcgttgcacgcgttgaacatgtccttcagccgcgcggcaccgtccagcagcgagtactgggtgtggacgtgcaggtgcgtgaacggcggctttgtcacggcgcgggtcctccgggggcggggggcgagggggcagcttcgaatcctacgtcggccgggtgacagatcacgggcactgacgggtacggtcgggcgttgcagaaccaggagggccgatccggcgtccagtcggtcggaacccgaaacagcccgtgcaccaggaggaacccgccatggcggtccccgagacgaccgacgagcagcgcgccgagcagatcctcgacgtgttcgacaccgcgttcggtgagctgctcgccgccgaccccgctgccttccaggtcaaattccgcaagatggcggcctcggccttcgccttctaccggggtaccgcctgcctcttctactccgacctggaacgggaccggcacggtggcccctacctggacgagcggacgggccgggtgtggatccacggagacctgcacgccgagaacttcggcacgtacatggactccaacggccggctgatcttcaacgtcaacgacttcgacgaggcctacgtcggtcccttcacctgggacctgaagcgcttcgccgcctccgtcgccctgatcggctacaccaaggcgctcagcgacgaccagataagcgagctggtgcggacctacgccggtgcctaccgggagcggatccaccgcctggccgcgggggccaagaacgaggaggtgccctccttcaccctggacaccgccgagggcccgctgctgggtgccctgcgctcggcccgctcccgcacccgcttctccctcctcgactccatgacggagatacgcgactacgagcgccgcttcacggccggcgggggcgccatcgagctggacgccgccacccgctacaaggtgctggccgccttcgacgggtacctggagaccctccccgacgagtcgctggtgcggccggactcctaccgggtcaaggacgtggtggggcgccgcggcgtcgggatcggctcggcgggcctgccctcctacaacatcctgctggaggggcacagcgacgccctggagaacgacgtcgtgatctacctcaagcaggcgcagaccccggcggcctcccggcacatcacggaccgggcggtgcgggagtacttccggcacgaggggcaccgcacggtcatctcccagcgtgccctgcaggcgcacgccgacccgtggctgggctggacggagctggacggggccgggcagctggtggccgaggtctccccgtacgcggtggacctggactggtcggacctggacgacccggaggagatcgcggccgtcgtcgcggacctgggccgggcgaccgcgaccatgcacggagccgccgacgcggacgagagcgggcagacgctggtgcccttctccaccgagcgggccatcgacgcggcgatcgccgccgacgaggagggcttcgcggagctgctcgtggacttcgcccacgcctacggggcccgggcgcgcgccgaccaccagatcttcgtggacctcttccgtaacgggcgtctcactccctgaacgcctgttccacaggaacgcgtggcacactcgcgaggatggacatttccgggacgggacccagggcgctgcgcgccgcgctgttcagcgcgctcgtcgtgctgctctcgtccggctcgcacgtcctgatgtcccgggtcccgctgccgccctcgctggtggccggggccttcgcgggtgtgttcgcgatcgcctacctgctggcgggccgcgagcgcggcttcggccccatcgccgggctgctcgtcccgctggagctggccgccgacaccgtcttcaccaccgggcagcacctctgctacggcccggcgggcgggcccgtctcgggtccgctgcgcgccatgggcctggacgccctgtgcggcggcaccccggtgggcgggccgctgaccgaggtgaccgggccggtcgacgcggccgcgctgctggcctcgcccggcccgtacacgccgtggctgctgctcggcgcacacgtctcggtggggctgctggcggccggctggctgcgccacggcgagcgggccctgggccggctgctgcgggcggtggccgccttcgcgttccggccgctgctgcttctggtggcctcggtcgcggcggtgtgccgcccggcgcggtcgctgctgcggtcggccctcccgggcgtcggggcccgtacgcggttccccgctcattccgtgggacggcggggacctcccgtgccgctcggcgcgctcgcgcgcgcctgacgcacgtacggcagtcccttccacacgtcacaccccacggagatcacgatgagttcacgcaacagccaggcgaacaaggcagcggcccgcgagcggctgcgcgccgagcgcgaggcccaggcgaagaaggacaaggtgcgccgccaggtgatcgtggcgggcggtgtggtcctcgccctcggcgtcatcggcgccatcggctacggggtcatgcaggccaaccagccgggtcactgggagaaggccgccaaggccgagctggtcaagccgcagaacaccacgggcgaggacggcaccacggtcgtcatcggcaagcccgacgcgaagaagaccctggagctgtacgaggactcccgctgcccggcctgcgccgccttcgagcaggcctccggtgagcagatccacaaggacgtggacgcgggcaagtacaagctccagtacatcggcgccaccttcatcgacaacgccgtcaagggcgagggctcgaagaacgcgctgagcgccctgggcgccgcgctgaacgtcagcccgaaggccttcctggactacaagggcgcgctctactccaaggacctgcaccccgaggagagcgtcgacagcttcgccaaggacgactacctgctgaaggtcgcggacacgatcccggagctcaagggcaacgccgcgttcaagaaggccgtcgaggacggtacgtacgaccggtgggcgctggagatgtcgaaggtcttcgacaagtccggggtgaagggcacgccgactctgaagatggacggcaagaagatcgacactccgcagacggcggagcagttcacggccgcgatcgacaaggcgctgcagggctgatcccgggctggtcccggtctgatccggacagcgggcgatccggaagaacaccgtccggacaggccgccgcacagggcgggcgaactcccagagttcgcccgccctttgcattcccgcacctgcccagcgggtgtacccgtgggtaatatgaccgcccgtgaccagtcatctcacctcctcccagtccgcggcaactccccgccgccgtacggtcgttctggccgctgcggccaccgccgcgctggcccccctcacctcgctgggcgcctcggccgcccacgcggcgggcaccgcgcccgccttcctccacggcgtcgcctcgggcgacccgctgcccgacggggtcctgctgtggacccgcgtcaccccgacccccgaggccgtaccgggctccggtctcggcccggccacccaggtgggctgggaagtggcctccgacaagggcttctcccgcatcgtcggctccggcacggtcaccgcgagcgccgccaccgaccacacggtcaaggtggacgtgcgcgggctccagccgcggacgccgtactggtaccggttcaccgccggcgccgccgtctcccccgtcgggcgcaccctgaccaccccggcccacgaggcgacgaccgacggggtccgcttcggcgtggtctcctgcgccaactgggagtccggctacttctccgcctaccgccacctggcggcccgcgcggatctgcacgcgatcctgcacctgggcgactacatctacgagtaccagtccgggggatacccggaggcgaagtacgtcgtacgcccgcacgagccgaagcacgagatcgtctcgctcgccgactaccgcacccgccacggcaagtacaagacggacgcggacctccaggccctgcaccacgcgcatcccgtcatcgccatatgggacgaccacgagttcgccaacgacgcctgggccggcggcgccgagaaccacacgccgggcgccgagggcgagtgggcggcccgcgcggccgccgccaagcaggcgtacttcgagtggatgcccgtacgcgcctccgtcgcgggcaccgtctaccgccggctgcgcttcggcaccctcgccgacctgcacctgctggacctgcgctccttccgctcgcagcagaccaaggtcggcagcggctcggtggacgacccggagcgcaccatcaccggccgcgcccagctggactggctcaagtcgggcctcacgggctcggaggcgacctggaagctggtcggcacctcggtgatgatctcgccggtggccttcggctcgctgcccgcgcacctgctgaagccgctggccaagctgctgggcctgcccgagggcggcctcgcgatcaatgtggaccagtgggacgggtacacggacgaccgcaaggagctgctcggtcacctcaaggaccggggcgtcaagaacaccgtgttcctgaccggcgacatccacatggcctgggcgaacgaggtcccgatgaacatggcgacctacccgggatcgggcacggcggcgaccgagttcgtggtcacgtcggtgacctccgacaacctcgacgacatgctgcacgtcctgccggacaccctctcgctggtcgccgagggcgccatcaaggccgccaactggcacgtgaagtggctcgacatggacgcgcacggttacggcgtcctggacgtgacggccgagcgctcgcagatggactactacgtggtgtccgacaagcggcagcagggtgccacctccgcgtggagccggtcgtaccggacgctgaacgggacccagaaggtggaccgggtgtaccagcccgtccgctgatcgtccgtcaattttcctgccacatggggcgcctgggacataccaggcgccccatgtgcgtgagaagcaacaaatcttttacgtaagccacttgacctgaatatgtcatgcacacataagcttcgcgccagctgaagaagatcttcaggccaccaccccccaccacaaccccccacgcgaggagcacacgtgcgcgcgaacgcccgcatatccccccttctccgccgccgcctgatgggcacggcgcttctggccggaaccctggccttcaccccgctggcggcccccaccacgctcgcggcgtccaagtcccccgccgaggtctgcgccgagcagcccgccgcctccggcgccgcgaacgcccgcgtcgcccgcgcccacgacgagcacgcggacgagcccaacgcgatcaccgacgcgcaggcgaaggccatggactccgacctccaggcgaagctggacaaggccctcaagaaccagccgcagcgcagcctgcgcgccgccgaggccgccacgaccatcccggtgtacttccacgtgatccactccgggaacaccggaaagctgacgtccacccagatcaacaaccagctggcggtcctcaacgcggcctacggcggccagggcaccggcaacgtcaacacgaacttccagttcaccctggccgggaccgactacacggacaacgcctcctggtacaacctggccgacggctccacggccgagaagaacatgaagaacgccctgcgcaagggcggccccggcgcgctgaacttctacaccgccaacctctccggcggcctgctcggctgggcgaccttcccgacgtcctacgcctccagccccaagatggacggcgtggtcgtgctcgactcctcgctgccgggcggctcctcggccaactacaacgagggcgacaccgcgacccacgaggtcggccactggatggggctttaccacaccttccagggcggctgtaacggcaacggcgactacgtctccgacaccccggccgagaagaccgcggccttcgagtgcccgaccggccgcgacagctgcaccaccaagtccggtgtggacccgatccacaacttcatggactacacgtacgactcctgcatgtaccagttcactgccggccaggtcgctcgcatgtcgagcagctggaccgcctaccgcgcgggctgacgaccaacggcaagggcccggtccggcatccgccgggccgggcccttgccgttctccgcgcctacaggctgtcgaggaagccgatggcgaccttccagagctgctcggcggcctcggcgtcgtagtcctccagctccgggtcggtgaacaggtgcccggcgcccgggtagctgtgcacctccacgtcggcccccgcccgctgcatccgcaggtaccaggccgtcagccagtcgtgcggctcgaaggggtccgggtccgcgatgtgcagctgcacgggcagctcgtccaccgaggcaccctcctccaggtccgccgtcccgtgcaggagcagcagcccgcgcgccttctcgtcggccatcgccaggtgctgggcgaccgaaccgccgaaggagaagcccgcgtagaccagcccctggtccgagtagggggcggcggccagcaccgcgcgcttcagcagttcgtcacggccgatctcgtcccggtgggccatgccctcctcgacggtcccgaaggtgcgtcctccgaagagatccggcacctggacctggtgcccggccgcgcgcagccggtcggccgccgcgtgcaccgcgggccgcagcccgtacgtcgaatggaaaagcacgatgttcatgcctccatcgtgccagccgccgaggacgggctgcccgcggcgtcctgcgccccgtcccggtcatcggcggcgcatccgatgcctgtgtcctatttcacgagcaggccgtacgagaaccggtcgcgcggcggcgggccggccgtgacggacaccacaccgcgcgcggtccgggtccgcgcggtggtcacggggaaggacgccgacgaccccggccgcggaggccctctaaaggagcgcggccgcgcactcctcggcgaggtcctcggcgtgcggtggcagcgggccgccggcgcgcaggtggcggcggacgaccgagagcgggaggtcgatcagggccagggtgacgcggtcgcggtcctggggcccggtcgcgccgagcgcggcggcgagggtgccgatggcggcgtacacccgctgattgccggcatcggcccggccggtgtgctcctcggaccagccggcacggccgaactcccacgggccgtagagcaggagggcggcctcctcggggtgggcgcggctccactccacgacgtgccgggcggccgcacgggcggcccggcgggggtcggtgtcgctgtgcaggctggcgaagtagccctcctggaagcgctccacactgcgcagccacacctcggcgagcagagcgctgcgcccggcgaagcggtggtacatggagccgctgggcgcaccgatcgcctgggccacggcggacatggtcacgccgcccggcccggcggaggcggccagccggacggcggcgtcgaggatctggtcggtgtcgaagcggggtggtctcgccatgaatcagagagtaccctccagattattagagacccctctctaataatgcgatggggaggaccctccatgggcgtctacaacgtgcacgagcgcgtgatcgcggcgaaggagagcgaggtcggcgcactgatcgacacgctggccgacggggagggcgaccggctgtggccccgccacctgtgggaggagatggagttcgaccgccccctcggggtcggagcggcgggcggacacggaccggtgcgctacacggtggccgcctacgtgccggggacctgggtgcggttcaccttcaccggaccccgggggttccacggcttccacgagtacaccgcgctgcccctcgacgccgagcgcaccgtgctgcgccacaccctggcgatgaacctcagcggcctcagccgcatcacctggccgctggccttccgccaggggcacgacgcctgcctggaggacagcctggaccgcgccgaactggcctgcacgggcacgatcgcccgcccggcccgctggtccccgtacgtccgcttcctccgcggcctggaacacctcgtgacccggcccgccgaggcgcgaccctagggtgtccgcaggctgcgtacgtcgagatggcgcagtacgcggtccacgacctccgggtcggagccgggctcgctgcgggcggacaggacctcgtggcgggcggccgacatcatctcccgctggatccgctggatgctgtggagccgctccacccgcttcgcgtaggcctcgcgccgctcctcgtccaccatgtcggggctgatcctggcccccacgtcgtacgcgcgccggtacagctgctcgaccaggtcctccggcagatcctccgtgtcctcgatctccttcaggcgccgcttcgcggccttggcggcgcggatcgccagccgccgctccgcatcccggtcggcgtccgtgtcggcctccacccccagccggcgcaccagccacggcagggtcagcccctggcacaccagggtcgtcatgatcaccgcgaacgcgatgaagatgatctggtcccgcccgggaaagggctcaccggcgtccgtccgcagcggaatggccagggccagggccaccgaggccaccccgcgcatcccggcccaccacatcaccacgctctcccgccagctcatcgggatctcttcgtcgtagtcgcgccgcttgtgcagccgctgggcgagccagccggccggcagcagccacagcagccggacgccgatgaccacggcgaccacgatcgccgcccacccggccatctcccacacgcggtcctcggccgtgccgaacacgttgtgcagctccagcccgatcaggccgaaggccacgccggtgaccagcatgtcgacgacctcccagaaggtgtgcccggcgaggcgccccagcacgtcgtcggcgtcgctcgcgtactcggcgaggaacagggccgtcgtcagcacggccagcacgcccgacccctggagctcctcggcgacgacgtacgcgacgaacggcaccagcagcgtcagcccgatctgcagggtggcgtcgccgagccggcccatgagccggttggcgatccagccgagcccgagcccgacggccacggccaccacggcggagagcacgaactccccgagcgcgtcgggccaggagaagctgccgctcacgacggcgccgacggcgacgtggtagagcacgatcgccgtcacgtcgttgaacaggccctcgccctccaggatcgacaccatgcggcggggcagcccgagcgatccggcgacggccgtggcggccaccgggtcgggcggggcgacgagcgcgccgagggcgagggcggcggcgatcggcagcccgggcacgacggcgttggcgacggcggccacggcggcggtggtgacgaacaccagggccacggccagcagcaggatgggccggacattggcggcgaactgccgccaggacgtgcgctgcacggaggcgtacagcagcggcggcagcaccagcggcaggatgaactcgggcgggatctcgacgttcggcacggccggcaccagggcgaggatcaccccgccgatggtcatcaggacgggcgcgggcagtccgagccggtccccgagcggcaccgtgaccacggccccgagcaggagcacgaacagcagagcaagctgatccactcccccaccctgccagtccgctgcgcttggcggtgcgggtcgggggccgtgtcggggctccgccccgacccctacggcgctccgcgcccgcgccgcggcgttccggctacgggaggggacgtcgcatcgcgcggtgcgggatgcccgcgtcctggaactccgggccgtaggccacgtacccgagccgctcgtagaagcccagcgcatgcgtctgcgcgcccaggtcgaccgccgtcagaccccgccgcccggcctccgcctcgatcgcgcggaccagcgccacacccacgcccagtccgcgcgcggccttggtgacggccagccggcccagcgagccgaccgtcgggtcgcccgtcttgcccagggcggccggcccgtacagcagccggcccgtgcccagcggcaccccctgcgcgtccacggccaggacgtgcaccgcgtccgcgtcgtacgcgtcgtactcgatcgactccggtaccgactgctcgaccacgaagacctcggaccgcaccgcgaagcaggacttcaggtcctcctccgaggcggcgacgcggacctcgaccgcgcccccggccggcgaggtcactcgctctccgcccggatcacgtccagcgcgtgctggaggtccgccgggtaggtgctctcgaactcgacccactgcccgtccgacgggtgctcgaagccgaggcgcaccgcgtgcagccactgccgggtgaggccgagccgcttggcgacggtcgggtcggcgccgtaggtcaggtcgccgacgcacgggtgccggtgcgccgacatgtgcacgcggatctggtgcgtacggccggtctccagcttgatgtccagcagcgaggcggcacggaaggcctcgatcaggtcgtagtgggtgacggacgccttgccgtcctggatcaccgcccacttgtagtccgcgctggggtggcggccgatcggcgcgtcgatcgtgccgctcatcgggtccgggtggccctgcaccagcgcgtggtagcgcttgtccacgacccgctcgcggaactggttcttcagcgaggtgtaggcgcgctccgacttcgcgacggccatcaggccggacgtgccgacgtcgaggcggtggacgatgccctggcgctcggaggcgccggaggtggagatgcggtagccggccgcggcgaggccgccgatgacggtggtaccggtccagccggggctcgggtgggcggcgacgccgaccggcttcatgatgacgacgatgtcgtcgtcgtcatggatgatctccatgcccgggaccggctcggcgacgagctcgaccggccgcggcggctcgggcatctcgacttcgagccaggcgccaccgtgcacacgctcggacttcccgacgacactgccgtcgaccgacacctttcccgcggccgcgagatcggccgccttcgtccgggaaaaaccgaacatacgggcgatggcggcgtcgacgcgctcgccctcaaggccatcgggaacgggcagggtgcggatctcgggaatcgtactcacccgtcgagtatgcaggacggggcggtcgagccgtcccgcgatcagtccttgtggacggtcccgtccgggtccaggcccttgaaggacagcaggacgatcaggatgccgccgcacacgatcgccgagtccgcgaggttgaagacggcgaaatgggcgggcgcgatgaagtcgacgaccgcgccccggaacacacccggcgcacggaagatccggtcggtcaggttgcccagcgcgccgccgagcagcaggcccagggcgatcgcccacggcaggctgtagagcttgcgggccagccgcacgatcaccacgatcaccgaggccgcgatgcaggtgaagatgatggtgaaggcctcgccgaagccgaaggcggcgcccgggttgcggaccgcctcgaatttcagcagctcaccgatgatctcgatcggcggctggtgctccagcttcgccacgaccagcatcttgctgccgaggtccagcaggtaggcgagcaccgccacgacgagcagagccgtgatccgacggcgccccttgggcccggcggactcaggctgggcttcgtccccgacctccggcgtaccgatgatgcgctccgcctctgccacgtgagtccctcgaactagctcgaaccaggctcctcctggaccctgacggaacacgagggtacgtcagggcccccgctcggcgcctgccccacctccccgacctcccgggtggtgccctcagtgccgccgctcctgcttctgcttgcagtccacgcacagcgtggcccgcgggaaggcctgcatccgcgccttgccgatgggctgcccgcagttctcgcagagcccgtacgtgcccgcctccagccgctccagggcccgctcggtctgttccagcatcgaggtggcgttcgcggccagcgccagttcggactcccgggtgatgttcttggtgcccgtgtcggcctggtcgtcgcccgcaccgtccccggagtcccgcatcaggccggagatcgccgcctcggaggcgtcgagctcggcccgcagccgcagcacctcggacaggagctcggcacgggcgtcctcgacctccttgggggtccaggggtcctccccgggccgtacggcgagctcgccgggggccagggccgccgtggcccgcgccttggggagcccgctggtggcggccgcagccgtcttcctcgccgtacctgcgctcttcttggcaaccactttccggactcccgtcttcttcgcggcatgtgccgccccctcggccacggccttcttggccgtgcccgtccgcttctcgacggtcgtcttcgtgacggcggtcgccttcccgtccggagcgtgcgcgccggcagcggtcttacgggcagcggtcgccttcttggcggggaccgcgtcctcggagaccgccgccttcccggcggccttcccgacggccttcttggcagtactcccggcggtcttcttcgccaccatggccgcggccccttcacatactgtgatctttgctcgcgaatcgtgccggaacgataaatcgacaccggccccgcggcaacggggcacgcatccgtcgaggtcaacctgcatccgttgtgcccatcaggagccccggtaatccgccactcccgccccacccgagtcgggggcggcaccgcgggcccattcgggtcacgccgggggcacgccggggtcgcgcgcggaccctccgcgcggccccgccacgccgggccggcgggccccgcacgggcccccgtaaaccggtctgccatgcgccccccgggcccgtacactgggcccagcgaaaggcatggacggggacgagtagcgtcgtacgcagccaggagcgacccggggacggtgagagcccgggggcgagcgcgatgtgaaggatcacccctgagccgccggaagaaagcccgcacgggacacccgtacggcgagtagaaccggcttcgcgccccaatgagggggccaccggatccgtccggcggccaaggagggtggtaccgcgggagcagcagcgctctcgtccctccggacggaattgacaccccgccggaggaagagttcagcctcatgaccacaccgccgcagtaccgcccggtacccgcccaggtcgacctgcctgcccttgagcacgccgtcctcgacttctggcgcgagagcaagaccttcgccaagaccctggagcagtccgagggccgccccgaatgggtcttctacgagggcccgcccaccgcgaacggcatgcccggcgcgcaccacatcgaggcccgcgtcttcaaggacgtcttcccccgcttccgcaccatgcgcggctaccacgtggcccgcaaggccggctgggactgccacggcctgcccgtcgagctcgccgtcgagaaggagctcggcttcaacggcaagcaggacatcgaggcgtacggcatcgccgagttcaacgccaagtgccgcgagtccgtgacccgccacaccgacgcgttcaccgagctcacgacccggatgggctactgggtcgacctggacgacgcctaccggaccatggaccccgagtacgtcgagtccgtgtggtggtcgctgaaggagatcttcaacaagggtctgctcacccaggaccaccgcgtcgccccctggtgcccccgctgcggcaccggcctctccgaccacgagctggcccagggctacgagacggtcgtcgacccgtcggtctacgtccgcttcccgctgacctccggcccgctcgcgggcgaggcggccctgctggtgtggacgacgaccccgtggaccctggtctcgaacaccgcggtcgccgcgcaccccgatgtcacgtacgtcgtcgcgaccaatggcgaggagaagctggtcgtcgcccagccgctgctggagaagtccctcggtgagggctgggaggccaccggccagaccttcacgggcaaggagatggagcgctggacgtacgagcgccccttcgacctcgtcgagttcccggctccggcccactacgtcgtgaacgccgagtacgtcacgaccgaggacggcaccggtctggtccaccagtcccccgccttcggcgccgacgacctcgcggtctgccgcgcgtacggcctgcccgtcgtgaacccggtccgccccgacggcaccttcgaggaggaggtcccgctggtcggcggcgtcttcttcaagaaggccgacgagaagctgaccgccgacctcgacgcgcgcggccggctcttcaagcacatcgcctacgagcacagctacccgcactgctggcgctgccacacggccctgctctactacgcgcagccgtcctggtacatccgcaccaccgccgtcaaggacgcgatgctgcgggagaacgagaagacgaactggttcccggactcggtcaagcagggccgcttcggcgactggctgaacaacaacatcgactgggcgctctcccgcaaccgctactggggcaccccgctgccgatctggcgctgtgaggagaaccacctcacctgcgtgggctcgcgcgcggagctgggcgagctgacgggcacggacctctccggcctggacccgcaccgcccgtacatcgacgaggtcaccttcacctgcacgcacgagggctgctcgctcgaagcggtccgcgtgccggaggtcatcgacgcctggtacgactcgggctcgatgccgttcgcgcagtggggctacccgcacaagaacaaggagatcttcgagaagcgctacccggcgcagttcatctcggaggccatcgaccagacccgcggctggttctacacgctgatggcggtcggcaccctcgtcttcgacaagtcctcgtacgagaacgtggtctgcctgggccacatcctcgccgaggacggccgcaagatgtccaagcacctgggcaacaccctggagccgatcgcgctcatggaccagcacggcgcggacgcggtgcgctggttcatggcggccggcggctccccgtgggcggcgcggcgcgtgggccacggcacgatccaggaggtcgtccgcaagacgctcctcacgtactggaacacggtcgccttccaggccctgtacgcccgcacgtcgaactgggcgccctccgcctccgacccggccccctcggaccgcacggtcctggaccgctggctgctctcggagctgcacgccctcgtcgccgaggtcaccgaggcgatggaggcgtacgacacccagcgcgcgggcaagctgctgtcctccttcgtggacgacctgtcgaactggtacgtgcgccgctcgcgccgccgcttctggcagggcgacgcggccgcgctgcggacgctgcacgaggtcgtggagacggtcacccgcctgatggccccgctcaccccgttcatctcggagcgggtctggcaggacatgatcgtcccggtcaccccggagtccccggagtccgtgcacctgtccacgtggccggtcgcggacacggcggcgatcgacccgacgctgtcgcagcagatgcagctggtccgccgcctggtggagctcggccgtgccacccgcgcggaatcgggcgtgaagacccgccagccgctctcccgggcactggtcggcgcggtgggcttcgacgcgctctccgccgagctgcagtcccagatcacggaggagctgaacgtctcctccctggcctccctgtccgaggtcggcgggtccctggtggacaccacggcgaaggcgaacttccgggcgctgggcaagcgcttcggcaagggcgtccaggacgtggcgaaggcggtggccgcggccgacgcggcggcgctgtcgctggccctgcggaccggctccgcggtgatctcgctgaacggtgaggagatctccctctcgccggaggaggtcatcatcacggagaccccgcgcgagggctggtcggtggcgtccgactcgggcgcgacggtcgccctggacctggagatcaccccggagctgcggctggcgggtctggcgcgtgacgcgatccggctgatccaggaggcccggaagaactcgggcctcgatgtggccgaccgcatcgcgctccgctggtcctccgcggacccggaggtcgtcacggccctgacggaccacgcgggtctgatcgcggacgaggtcctggcgacggacttcgcgtccggcgacgccgacgacgcctacggtgacccgttcaccgacgaggccctcggcctgacgttccgcctccgcaaggcgtaacccgcggcccgagcggcccgtccggcccgagcggcccgtcccctcccgggtggggggacgggccgctttcgtctgccccgccgtgtcccggggctccgccccgctcttccagccccgccggcgtttgaggcgcgggggctcgggggcggagcccccgcaacggcggcgcggccgggtacggaaacgggccgggcccgaggttccgtagaacctcgggcccggcccgtagagcgcggctgccgaccgcagaatcggcggcggcgcctagttgtcgtcctcgtcgatcaggaagccccgcatcggcgacggcgcctgcatcggctgcggcgcagccggccggaccggagccatcggctgggtcatggccggggacatctgctgctggttgccgccgtaggacggggcacccatcggggagggaccgcccatgggggacgggccacccatcgagggaccgcccatggagtggcccatcgcaccggccggagccatcgagggcgacggcgacggcggcagcgcgggaccggccgggttccgcggcggggccagggagtcgtcggcctgggtctccagctggcgcagctgcgactccaggtaggacttcagacgcgtacggtactcacgctcgaagccccgcaggtcctcgaccttgcgctccagcgtggcgcgggcggactccagggagcccatcgcgacgcggtgcttctcctgggcgtcccgctccagcgcgtcggccttggcgcgggcgtcccgctccaggccctcggcgcgcgaccgggcctcgccgacgatcttgttggcctcggagcgggcctccgcgatcgcctggtcggcggtctgctgcgccagcgacaggacgcgggcggcgctgtcgccaccggggccctgctgcggaagctgcggctgctgctggtgcatcggctgacccatgggctgcatctgctgccccatcggctgcatctgctggcccatgggctgcatctgctggccgagcgggttctggccgcccatcgactgctgctgctgcatgccctgggggccgcccatgggctgctgctgcatgccctgcggtccacccatggggtgctgctgcatgggaccgcccatggggccgcccatcgggccggggccctgctggccctggccgccggggcccggcggaagctgcggggcgccgcccggaagctgcggggggcccatctgctgctgctgctgcggcgggccggatatggccgcgggcacgggggcgccggggcctcgctggtcctggggttccggcttgcgcatgccctgctgctgctggttctgcgcggcggcacgcgtggcggcggccagcttggcgcgcaggtcctcgttctcgcgcagcaggcgcgtcagttcggactcgacctcgtcgaggaaggcatcgacctcgtcctcgtcatagccttctcggaggcggacggtcgtgaactgcttgttccgcacgtcctcgggagtcagcggcatgtcttcttcacctctacgtagtcgtcggcagtcggcaagaccgtatcgggactgtccccgcgcccgcggggaagcacatcgttcacaagccgctcgcagcggtgcgcacgaaactgatgaggatgtaaacgatgatcatcagaacgaagaaggacaggtcgagtgccacgcccccgagacgcaacggcggaatgacccgccgaagaagcttgagtggtggatcggtgacgctgtaggtggcctccagtacgaccaccatcgccttgccgggcgtccaggaacgtgcgaactggaacacgtagtccatgaccaggcggaagatcagcacgacgaggaagcacgccaaggcgaagtagatcacgtccagtacgacacccatcccgcgcttccctctcccctgctcccgctgtgttcccggccccgtgtctgacggatcggtctagctttggttgaagaacccgccctccgcgatgcgggccttgtcctccgccgtgacatcgacgttagcaggcgacagcaggaacaccttctgtgtcacgcgttcaatgctgccgtgcagaccgaagacgagtccggcggcgaagtccacgagacgcttcgcatccgtgtcgtccatctccgtgagattcatgatcaccggagtgccctcacggaagtgttccccgatggtacgggcctcgttgtaggtccgggggtgcagcgtcgtgatgcggtacggctcccgctcggagacgaccttgggcatgatcacgggggcgttcttctccaggttcgtgcgatcaggtgtgatggatgccacgggggcgattcgcgcaggacgtccgctttccaccggaattgggataggttcacgctgcgccggaggctgtgcgactcgtaccggttcatccggtacgggcgcttggtgcacgggctgctgtcggcgatcccgttcccgagcccgttccatttccggctcgggctcgaactcgtcgtcggggtcgtaccccgggttgtcgtaccggtcgtcctccacgaggccgaggtagaccgccatcttgcgcatcgcgccggccattctccgagtcctccgctctgtggtggatcgccctgtcgcaggtgccgccgtgtcacgaatgtcaccaactgcccgcgatccactaggtctgcccgcccatcagcgggaatgaccatattttctgctgtggtccgactttcttcgcgacgttacccgagccggggtctcgcgccgagtaccgcagtgccgacgcgtacatgtgtcgcaccggccgccacggcctgttccaggtctgcgctcatcccggccgacaccatcgtggcagccggatggtccacgcgcacgcgggatgacaattccatcaaccgctcgaaagcggcctgttcgcgtcccgcgtagcggccggacagcggagcgaccgtcatcaggccgtcgatgcgcagtcccggggccccggccacgaggtccgccaactccgcgagctgctccggtgccgcaccgccgcgggccccgcgctcccccgattccgcgtcgagcgcgatctgcacgaggcacccgagctcccggccggcgttcaccgcggccgccgaaagggcggtcacgagcttcggccggtcgaccgactgcaccacttgcgcgtatcccgccacggaacggactttgttcgtctgcaactgaccgacgaagtgccagctgagcggcagatccgcgcaggccgcggccttgggggcggcatcctggtcacgattctccgcaacatgacggacacccaggtccgccagcagtcgtacgtcgctcgcggggtaggtcttggtgaccacgatgagcgtcacctcgtcccgttcccgccctgccgccgcgcaggcggacgagatacgttcctccacccgcgccaggttctcggcgagctccgacttacgatccgtcattcttcttttcccccggcgatccgggggtcgtcccccgggaaagctctgtcaaccagacatatccggcaaggcgtccggtcacccggtcgcgccggtacgagaagtggtccggcgactccagtgtgcagaccggggaacggccgctgtgcaccacccccgcctcggcgagctgggcgtgcaccccggcgaccacgtcgacggccggtgtcccccagctggtctcggcccgggcggcgggcacctcccgggccaccgcctcccgcatctcggcgggcacctcgtagcagtgtccgcagaccgcgggtcccgtacgggcgacgatccgcccgggatcggccccgagggcgaccatcgcctcgacggcggcgggcaccactccggcgaccagtcccggccgcccggcgtgggcggcggccacgacaccggcgacggggtccgccagcaggaccggcgtgcagtcggcggtgagcaccgcgagggcgagcccccgacgggcggtcaccaccgcgtccaccgcggggacctcggcatccgcgccccagggcccgtccaccaccgccacgtcccggccgtgcacctggttcatccagaccacccggtccggctccagacccagggacttcgccgcccgtgcccggttcgcgcgaacggcggccgggtcgtctccgaccgcgccgccgagattgagctcctcgtacggaacggcgctcactccgccccaccggtcggtgaaggcgaagtgggcgccgcccacgtgatgctgctctggtgtcacttcaagaagtccgggacatccagctcttcggccgggctgtcctggtacggccgggccgtggggacctgcggcgcgggggcctggacctcgaccggagccggctcgaccggagccgggggctcctcgcgcggggtgaccgagcccagtccgccgaaggccgggcgggccggctcggcggcgcggaccggagccggggccggctcctcgcgcttggtggacgcggcaccgatgacgttgtcccggcgggccggaggctgtccgccgtcgaacccggccgcgatgacggtcacccgtacctcgtcgccgagcgcgtcgtcgatgacggcgccgaagatgatgttcgcctcggggtgcgcggcctcgctgaccagctgcgcggcctcgttgatctcgaagagaccgaggtccgagccaccggagatggagagcagcacgccacgggcgccgtcgatggacgcctccaggagcggcgaggagatcgccatctccgcggcggccaccgcgcggtcgtcgccgcgggcggagccgatgcccatcagggccgagccggcctcggacatcacggacttgacgtcggcgaagtcgaggttgatcagacccggggtggtgatgaggtcggtgatgccctgaacgcccgagagcaggacctggtcggccgacttgaaggcgtcgagcacgctgacctggcggtccgagatggacagcagtcggtcgttggggatgacgatgagggtgtcgacctcttcgcggagctcggcgatgccgtcctccgcctggttcgcgcggcgccggccctcgaaggtgaacggccgggtgaccacaccgatcgtcagggcgcccagcgagcgcgcgatgttggcgacgacaggtgcgccgcccgtgccggtgccgccgccctcaccggcggtgacgaagaccatgtcggcccccttgaggacctcctcgatctcctcgcggtggtcctctgccgccttgcgaccgacggccgggttggcgccggcgccgaggccacgggtgagttcacggccgacgtcgagcttgacgtcggcgtcgctcatcaacagcgcctgggcgtccgtgttgatggcgatgaactcgacgcccttgagaccgacctcgatcattcggttgatggcattgacaccaccgccgccgacaccgatgaccttgatgactgcgaggtagttctgcggtgctgccacgtcgaaggcctctcgcctcgagttacgtgtcgccgcctcgcgggcctgcgttgcgacgactgatgccgaaatagggacggtccgaacgcgccgacccgaaccctcaccctgaagtttagggttaggggtgtgcctgttcctcggactcttccgaacaggacactaagtcgacaagtagcgcgtgttcaacgaacacgccgaacctcccgtttttcttttcaccctatgtgatcacccgtatcgctggccaaccagggtgcgccgctgttggaccggacgtcaactcccggacgcagcaggggcggtggggacgctcacgtcgaagtgggcggccttgggagcggctttcaacaaagcgttcaatgcccgccccttcgcgtcgctctgttcaccgctcccccacgtcacggaccggcccctggtgagctccagcacgaccgaatcgtaggaacccaccttgacctgcaccgtttccctggcgatcggctgcgggagggcgcccgcgacgagtacggcctcgtgcagcagccgatcctcgtcgaagcggcgggcgctcggcgatcgaccggcgttcaattcgaggaccggaacacccgcgggtgctttcggaaccgtgtcgaatcgcacacccgatgcgtccacttccacgaagttggcgtcctttttgacgagcaggacaggtttgcgttccgtcactttcagaccgatgccgtgcggccaggcacgcaccacgtcgaccgaatcgacgcggggcagccggccgcggacccggctctcgatctcctcggtgtcgacgctcaccaggggcgcgccgaccgggacggccgccgcgccgaggacctgctcggcggtgagcacctccatgccggtggccgccaccttctccacgcggagccaggaggagccgtagagcacccaggtgccgccggcggtgaggagcaccgcggcggcgagcgcggccagcaccgggccccggcgcaggcgtgcgccggggcccctggggccggtcctctgcgctgacttcggggccttgggggtcttgggagccttgggcgccctggagcccttgggagccttcggcggctggggagcgccggtgcccttgcgggcagccggaccggaccgatcagaaaacggtgttccgcgccgcgcggtcgtccctccggccactcctgtgcctcctgcgtctgcgctacccgcctcagcgggacctgtgggccgcgatcgcctcgtacaccatgccgaccaggagctcgtcggcgtcccgccggccgaactcaccggcggcccgggacatctcgtacaggcggtgcgggtcggacagcaccgggaggacctggcccagcacccagtcgggcgtgagctccgcgtcgtccacgagcaggccgccgccggccttgaccaccggctgggcgttgagccgctgttcaccgttgccgatcggcaacgggacgtaggcggcggggagcccgacggcggagagttcggcgacggtcatcgcacccgcgcggcacagcatcatgtcggcggcggcgtacgcgagatccatccggtccacgtacggtaccggcacatacggcggcatcccgggcatgttgtcgacacgcggcagttcgttcttcggcccgacggcgtgcaggatctggatcccggagcgctggagggtcggtgcgacctgctggatcgtctcgttgaggcggcgggcgccctgcgagccgccggagaccagcagcgtgggcaggttggggtccaggccgaaggcggcgcgcgcctccgggcggaccgcggcccggtcgagggtggagatggagcggcgcagcgggatgcccacgtagcgggcgccgcgcagcttgctgtcgggggtggagaccgcgacggcgtgcgcgtaccgggagccgatcttgttggccagtccgggccgggcgttggcctcgtggacgatgatcggcaccccgaggcgcttggccgcgagatagccgggcagggccacgtaaccgccgaagccgacgacgcagtcggccttggtgcggatgaggatctcctccgcggccttgatggtgccgcgcagccgtccggggacggtgatcagttccggggtcggcttgcggggcagcggaacggcggggatcaggcccagctcgtagccgcgttccggcaccaggcgggtttccagtccgcgctccgtgccgagggcggtgatgcccactgaagggtcctgcctgcgcagggcgtccgcgagggcgagcgccggctcgatgtggccggcggtccccccaccggcgagtacgacatgcaccgaaattcaccgctctccggacggacgcttcttgacgcgccgtctcatcgacttccatctcaccccggtccgccaccagccggtcttcggctgtcgcatcgcgagggccgcgcgcgccgccggctcctcacgcgcgaaggcgatgagcagtccgaccgcgaacatggtcggcagcagggctgaccctccgtaggagaacagcgggagcgggactccggcgatcggcagcaggccgagcaccgcaccgatgttgatcacggcctgggccgtgatccaggtggtcacgcctcccgcggcaaaccgtacgaaggaatcctccgtgcgtccggccacgcggatacccgcatagcctagagccgcgaacagggcgagcaccgacagcgtccccgccagacccagttcctccccggtgatggcgaagatgaagtcggtgtgggcttcgggtagttgcccccatttttccacacttgcaccgaggccggaaccgaaccatccgcccgaggcgagggcgtagatcccgtgaacggcctgccagcaaaggtcgttcttgcccggttctgtcgcaccgagacattccagtcggtccatccggtgcgggctcgtcttgatgagcagtgcgacgatcgcacccgcgaagacgagcaccccgacgaacatccgggtcggggccccggccagccagagcagaccgaacaggatggcgccaaggatcatcgcggtgcccatgtcgccgcccagcatgatcagcccgagcagcaggaaggccaccggtaccagcggcaccagcaggtgcttccactggctcagcagccccttgtcgcccttgcgtgccagcaggtcggcgccccacaggatcagtgccagcttgccgaactcactgggctgcagcatgaacggaccgccaagggagatccaattctggttgccgttgatcgcgacgcctatccccggcacctggaccaggaccatcaggaagagcgtgccggcgagcacgggataggacagcgcccggtgcagtttgaccggcatccgggaggcggccagcaggaggacgccgccgatgagggcggccaggaactgcttcttgaagaagtacgcgtcgccgaggccgagctggagggccttgatcatcgaggccgagtacaccatcaccagaccgagcacggtgatgagcagggaactgccgaaaatcaggtagtaggcggtgagcgggcggtcccaggccttctgcaactgccgctgggtgttccggaaccgggccagcggcccgcgcccggcgggccgcttcgaactcaccgcagggcgtttgcggccctgcgccttcacggcggacggccgccgccccggcagcatctgcttggccggcatctgtgatcttcccctccactcgtacgaggcgagctgccggccggagggaacctgtcccggagccccggcctaggccgtgtccgcagcgttctcggcggccagttcgcgcaccgcgtcggcgaatgcgtccccacgcttgttgtagttcgcgaacatgtccatcgaggcgcaggcaggtgccagcaggaccgtgtcgccgggctcggcgagcgcggcggcttcccggaccgccgcgagcatcgccccagtgtcggtccggtcgaggtcgacgaccgggacctcgggcgcgtgtcgcgccagcgcgtcggcgatgagcgcccggtcggcgccgatcaggacggcgccgcgcagccgcttcgcggcgttctgcacgagctcgtcgaaggtcgcgcccttggcgagaccgccggcgatccagacgaccggctcgaaggcggcgagcgaggcctcggccgcgtgcgtgttggtggccttcgagtcgtcgatgtaggtgaccgaggcgacctcgtccacgtacgcgacgcggtgggcgtccgggcggaagtcgcgcagcccgtcgcgcaccgcccgtggctccacgccgaaggcgcgggccagtgccgcggcggcgagcgcgttggcgatgttgtgcggggcgggcgggttgacgtccgcgacctcggcgagctcctgggcgttcttctgccggttctccacgaaggcccggtcgacgaggatgccgtcgacgacgccgagcatggaggggccgggggcgccgagggtgaagccgatcgcccggcagccctcttcgacgtcggcctcgacgaccaggtcctcggtggccttgtcggcgacgttgtagacgcaggcgaccctgttgccctcgtagatccggcccttgtcggcggcgtacgcctgcatcgaaccgtgccagtcgaggtggtccggggccaggttgaggacggccgccgagtggacgcgcagcgagggcgcccagtgcagctggtagctggagagttcgacggcgagcacgtcgtactcctgctcgccgagtaccacgtcgatgatcggggtgccgatgttgccgacggccgcggtacgcaggcccgcggccttcaggatcgacgccagcatctgggtggtggtggtcttgccgttggtaccggtgatcgcgagccattcggcgggcccggccggggcccggtcgccggccgcggccccgcgggcggcacggagctccgcgccggcgccgcgcagccgccaggcgacctcgacgtcaccgacgacgtcgacgcccgccgcggcggcggccaggaagagcgggctctccggctgccagcccggcgaggtgacgaccagttcggtgccctcgggcagggtctcgcccgcccgggctccgtcgggcaggtgaccgaggcggacctcgatgccgagctccgcgagctcggcggccctggcccggtgcgcgtcgccgtcgccgttgtcgacgacggtcacgcgcgcgcccagcccggccagtgcccgggcggcgctgatgccgctgatgccgagccctgccacggtgatccggcccggcaggccgaagcggcccagggcgtcggggccgagcacggcggccaggtcggaggaggtcacttgtcggctgcccatcccgcgtagaagagaccgagaccaacgatcacgcacatgccctggatgatccagaagcggaccacgacgagtacctcggaccagcccttgagctcgaagtggtgctgcagtggcgccatccggaagacgcgcttgccggtcatcttgaaggaaccgacctggatgacgaccgacatcgtgatgagcacgaacaggccgccgaggagcgccatcaggaactccgtgcgggagcagatggcgaggcccgcgagcgcgccgccgagggcgagcgagccggtgtcacccatgaagatcttggcgggcgaggtgttccaccacaggaagccgaagcaggcgcccatgagggcggaggcgacgaccgcgaggtcgagcgggtcgcgcacctcgaagcaggcgttcgggttggtgaggtcaccggcccgggcgcaggactcctggaactgccagacgccgatgaaggtgtaggcgccgaagaccatcacggcggcgccggtcgcgagaccgtccagaccgtcggtgaggttcacgccgttggacatcgccaggatcatgaacagggcccacaccacgaacagcaccggacctatcgaccagccgaagtccgtgacgaacgacagcttggtggaggccggggtcagcccgcgcgagtccttgaactggagggccagcacggcgaaggcgatgccgacgatcagctggccggccatcttggccttggcccgcagacccagcgaacgccgcttgacgatcttgatgtagtcgtcgaggtacccgacgaggcccatgcccgccatcaggaagagcacgagcagacccgagaagctcggctcttcgccggtgaggatcttcgtcagggcgtacgcgatgagcgtcgccaggatgaaggagataccgcccatggtgggcgtgcccttcttcccggcgtggccgcgggggccgtcgtcgcggatgaactggccgtagcccttgcgggccagcagcttgatcagcagcggggtgcccacaacggtgaggaacatgccgatgacaccggcgaacagaatctgcctcatcggtcggcgacctcgccctcgacagtgctgtcgagaaggccctgggccacccgctccagaccggccgacctggaagccttcaccagcacgacgtcacccgggcgcagttcactgcgcaacaggtcgaccgccgcctgcgcgtcggacacgagcaccgactcctcaccccacgaaccctcgttatatgcgcccagttgcagccaggaggcttccctgcccccgaccgcgacgagcttgctcacgttgagccggacgacaagtcgtccgaccgcgtcgtgctcggcgagagcatcgtctccgagctcggccatcgggccgagcaccgcccacgtgcgtcccccgttcgccctgccggcaccgcccatcgcggcgagcgcgcggagtgcggcccgcatggactcggggttcgcgttgtaggcgtcgttgacgatcgtcacaccgtccgcccgctcggtgacctccatccgccaccgcgacagcgtgcccgccccggagagcgccgtggcgatctcctgtgcggacatgcccaggacatgggcgacggcggccgcggcgagcgcgttcgacacgtggtgctcaccgtacagccgcaaggtcacgtcgctgcacccggtcggtgtgtgcagtgtgaaggaagcctgccccctgtccgtcatgcggacttcggtggcccggatttcggcgtcctcggcctcgccgaagaggaccgtacgcgccttcgtccgcgcggccatgccgcgaaccagcaggtcatcggcgttgaggacggcgacgccgccctccgcctcggccggcagggcctcgaccagctcgcccttggcctgggcgatctgctcacggccgccgaactcgccgatgtgggcggtcccgacgttgaggaccagaccgatccgcgggggcgtcagtccggtgaggtagcggatgtggccgatgccgcgggcgcccatctccaggaccaggtgctgggtgtcctcggtgacgcgcagcgtcgtgatcggcaggccgatctcgttgttgaggttcccgggggtccacacggtcggcgcgtggtgctgcagcacctgcgcgatcaggtccttggtggaggtcttgccggcggacccggtgagggccacgacgtcggtgcccaggcgggtgaccacggcccgggccagcgctccgagggcggccaccacgtcggggacgacgatggccggtacgcccacgggccgggtggcgaggacgcccacggcaccggcggacacggcgcgttccgcgtagtcgtggccgtcgacccgctcaccgacgaacgcggcgaacaggctgccctgccggacctcgcgggagtcgtagaccacgggaccggtgacctggacggacggatccggtatgtcgtggggccgcccgccggtgatgtcggcgatctcggccagggaaagggcgatcactggttcacctcggcctgtcggacctggatcgtctggtcgagcacggcctggtgctcgatcgcggcacggagcaccgtgcggtcgtcgaaggggcgtacgacaccggcggtgtcctggccctgctcgtggcccttgccggccaccagcacggtgtcaccgggcccggcgagggcgacggcggccgcgatggccgaggcccggtcggcgtcgaccaggacggtgccccgctcgccggccggtacggacacggcgccctcgaacatcgcggcgaggatcgcgagcgggtcctcggagcgcgggttgtcggaggtcaggacggccacgtcggcgtaccgggcggccgcggcccccatcgggccgcgcttggtggtgtcgcggtcgccgccgcagccgagcacgatgtgcagcctgccctcggtgacctcgcgcagcgcgcgcagcaccgattccacggcgtccgtcttgtgcgcgtagtcgacgacggcgaggtacggctgtcccgcgtccacgcgctccagccggccggggaccccggggaccgcggcgacgccgtcggcggcggtctgcgggtcgaggccggcggcggcgagcgtgacgatcgcggcgacggtgttggccacgttgaacgggccgggcagcggtgcggtggcccgtacgcgctgtccttcggggcccagcagggtcagggtggagctcgccgggccgaagaccacgtcctcggcgcgccagtcggcggcggggtcgccggcggcggagaagccgacgaccgggatcgtcgcctccttggccaggcggcggccgtactcgtcgtcgaggttgaccacgcccaggcgggcccggcgggccgtgaagagccccgccttggcctggaagtagtcctccatgtcggagtggaactccatgtgctccgggctcaggttgttgaagacggcgacgtcgaagacgcagccgtcgacccggccgagcaccagcgcgtgactggagacctccatggccacggcctcgacgccgcgttcgcgcatgaccgcgaagagggcctggaggtcggtggcctcgggggtggtccgctcggacttgatgcgctcgtcgccgatgcgcatctcgacggtgccgaccagtccggtgctgcggcctgcggcgcgcaggccgccctcgacgaggtacgccgtcgtggtcttgccggaggtgccggtgatgccgatctggagcaggccctcaccggggcgtccgtagatcgcggcggcgagctcccccatccggccgcgcgggtcgtcgacggtcaggaccggcaggccggtggccgcggcgcgctccgaccccgcggggtcggtcagcacggcgacggcgccgaggccggccgcctgggcggcgaagtcggcgccgtgcgtcctggctccgggcagggccgcgtacaggtcaccggggcggaccgcacgggagtcgtgcgtgatcccggtgatctgcgccgggccgggcgccgggacgcccagcagcgcggccagctcgcccagcgggctcgggctggcggacgcgggccggggcgctcccggcggcgttgccggggctttctgggtcgttctgggctgatcagcgtggggcacggcggtgagcgtaccgggcgcggcgggccgctcgcgaagtgaggccccggcctcggcgtcggcggtcgtcgggttcccgggtttcggggtgatggttgtcactgatggtgcctcacgcttttctggcgggccggcctggttgtgggtcactggccgggctgcggactgggctgcggggcgggctgcggggcggcgtcgtaggtgacgggaagcccggcgggtgcggttcccgtgggggccacctggagggtcttgagcgcgaactccatgaccttcttgtagatggggccgcagatctggcctccgaagtagctgcccttcgtggggttctggatggcgcagtagacggtgatgcgcgggttgtccgcgggggcgaatccggcgaaggaggcggtgtagcccttgtagcggccggtggccggatccacccggttggaggtgccggtcttgccgccgacccggtagccggggatccgcgccttggtgccggtgccctcctggtcgtcgaccaccgattcgagcatctcggcgagggtcttggcggtctccgcgctgaccacgcggctgcgctcgggggccggggccggggtgaagcggccgtcggggcccttggtgccgcgcaccagcgtcggctcgatacggaccccgccgttggcgatggtcgagtacacggaggccgcctgcatggcgttgagggagaggccctggccgaaggggatcgtgtactgctgggaggtcgaccagtcctcgggatcggcgaggatgccgcgggactcgccggggtagttcaggccggtgggtcggccgatgccgaacttggtcaggtaggagtgcaggaccttgttcgcctccggctgggtgggcccgagctggccggtggccaggatcgtgccgatgttggaggacttggcgaggaccccgttgagggtcaggtaccaggtcgggtggtcgatgtcgtccttgaacaaccggtcgccgcggtgcagccggttggggacctcgacccgggtctccggggtggccttcttctcctccagcacggcggccatcgacatcaccttggcggtggagccgggctcgtacacgtcctggagcgcggcgttgcccatggcggcggagcgggcccgggtcaggtcgttggggtcgaagcccggggcgttggccatggccagcacctcgccggtccgggtgtcctggacgatgacgtagccgcggtcggcctcggacttctggacctgctcggcgatggcgctctgcgccgcccactggatgtcccggtcgatggtcagctcgatgtcgtcgccggggacggcgggcttctcgtcggagtcggcggtggggacctggcggccgccggactgggcgtaggtgatctcgccgtccttgccggacagcttcttgtcgagggaggactccaggccgccgccgcccttgccctcggcgttgacgtaacccagtatcccggcggcgaggtcgccgttcgggtacacgcgcttgctgctggtctccttgaacacgccggcgaggacgttggcgccggggccgttgttgcgcttgtcggccgccgccttgtccgcgaagacccgcttgaggtccttgatctggttccagacctggggggtccggcgctgggcgaggacgacgtaccgggagttcttggtgctcagccgctcggtgagctccttggcgtccttgccgaggatgggcgcgaggagggcggcggcctgctgcggggcgtccggggccttgctctcctgcggggtgaacatcttcgggtcggcggtgatgtcgtaggcgtcgacgctggtggcgagggccacgccccggcggtcggtgatctcaccgcgctcggcggccagcttgacgcgggtgtagcggttcttggaggcctcggcggagaacgccgacgcgtcgacggcctggacctggagcaggcggaccacgaaggccagcatgacgagggtcaggccgacgccgacgaggcgcagccggggccgcgggctgccgagccggatggtgtgcggggtacgggggccggtcggccgtcgggtcgccgggcgcgaggcagggcgggcggtggcccgggcccggtcgccgggccgggacggcctggacggtccgggcacccgccgccggggcggctcctgcgggctcacgcggccaccgccccgggcagggcggtgcccggcgtcccggggcgccgcccaggaccccgcgcctcacgtgccggcgaggctggttcagacgggatccgcgtcacgacgtcaccttccaggggtctggctgggctgcgggctgccgctgggagcgggctgggcgggggccggcgccgtgggcgcggccggggactggcccgccgcgggctgcgcgggcggaggcgtcggggtcggggtgggcgacggcggggcctcggcgaccgccgggctgccggcggtcccgccgtccgggccgatgaagaccgggctgccgccggggaccaggcccagctcgtgcgcccggcgctggagcgcgtcgggcgcggagtaggcgtccacgtcgcgctgcagcgcctgctcctcgtcggtgagggtggtggtctccttcctcagcttgctgagctggaaggagccctcgttcagtgccgagttcagcagcagcaggctgatcaggccgccgccgagcagggccacgaccagcaggacgaacggcatccgcgccgcctgcccgccgggacgcgggcgggccgggcggccgccgagcgcccggccgaggcgggccgcctgcccgcgggtcagcgtggcgaccttcccggccttggtcacagtcgcgcctcccggatgcgttcgacgccgcggaatctggccggggcggcccgccggttctcggcgatctcctcctcggtgggcagctcggcgccgcgcgtgagcagtttcagcttcggctggtacttctccgggaccaccggcagcccgggcggggccgtggaggtcgcgccggccgcgaagacctgcttgaccaggcggtcctccagcgagtggtacgagagcaccgcgatccggccgccgaccgcgatccggtccaccgctgccggaatggcccgctccagcccggagagctccccgttgacctcgatccgcagcgcctggaaggtccgcttcgccggattgccgccggtgcgcttggcggcctgcggcagggagtcacggatcagttcgaccagccgggcgctgttggtgaagggctccttctcccgctcccggacgatcgcggagacgatccgcttggcctgcttctcctcgccgtactggcgcaggatccgcaccagctcgcccggcgcgtagctgttgaggacctcggcggcgctgatgcccgtcgtctggtccatgcgcatgtccaggggcgcgtcctgcgcgtacgcgaacccgcggtcggcctcgtccagctgcatggaggagacgcccaggtcgaagaggatgccctggacggccgggatgccgagctggtccaggacctcggcgaggtcggcgtagatcgcgtggacgagggtggcccggtcgccgaagggcgcgagccgctcgccggacagccgcagggcctccttgtcacggtcgaggccgatcaggtgggcctcggggaaccgggtcagcagggcctcgctgtggccgccgaggccgagggtgcagtcgacgacgacggccccgggcctctccagcgccggggccaacaggtccaggcaccgctggagcatcaccgggacatgtcgggactcgctagtcaaagcgccctctcagataacggcgcggcaggcgtacgcaccgccggatccccgcatccgcgaccggcgccggggaaggtggcgccggccggccggtgagcgggagagggccgggccgtacgtacgcgccgcgcacgcggagtgttcatcgggggccgggcggccggtcagggccgggctccggccggttcgcgtcactttagtgcaacggtcgccgcggtcaacgaaccgcccggcgcgccgtgtgcggcactcggactgaaccggcaaatgccgtgaatcacccgaacagtcgcctcacccccacccctgtgggttagctcacaacaaggcgcgttgacgttctttgtccactctcacgcgaggccccgccccgccgtgaccattaacgtcgtacccatgacgacttccgcatccctgcctgcagagtccgcgtccgaggcatccgtcggcggatccgtcaccgaccgcctggtcgaggcgaatcagcgctacgccgcacagttctccgaccccggcatggacgcccgtcccgtcctgaaggtcgccgtggtggcctgtatggacgcccgcctcgacctgcacaaggcccttggcctggagctcggtgactgtcacacgatccgtaacgcgggtggtgtggtcaccgacgacacgatccgctccctcaccatcagccagcgggcactgggcacccgcacggtgatactcatccaccacaccggctgcggcctcgaaaacctgaccgaggacttccggcacgagctggaggacgaggtcggtcagcgccccgcctgggccgtcgaggccttccgggacgtcgaccaggacgtccgccagtccatgcagcgggttcgcacgaaccccttcctgccccacaaggacgatgtgcgaggcttcgtcttcgatgtgcacaccgggctcctgcgggagatcgatcccagctcttgagtgacacgaggccttgacgccgtcaagaatgcggggtggcaccacccgggatcccccgggtccggtgtccgtgtttcggggtgggccggtcatgcgccaagggcgtcggccctggaaatgggccgaggagaaccaaggtgacgacgtacgacgaccgagcgagcctcgcggatctgaccagcacggtggagcgggtgcgccagtcggtcgagagcgtgatcgagggcaagcccgaggtcgtccgcctcgcgctgaccgtgctgctcgccgaggggcacctgctgatcgaggacgtgcccggcgtcggcaagacgatgctcgccaagacgctcgccaagtccatcgactgctcggtgcagcgcatccagttcacgccggacctgctgccctccgacatcaccggtgtcagcatctacgaccagcagcgccgcgagttcgagttcaagccgggcgcgatcttcgcgcagatcgtcatcggtgacgagatcaaccgcgcctcgccgaagacccagtccgcgctgctggagtcgatggaggagcgccaggtcaccatcgacggcacgacctacacgctgcccagccccttcatggtcgtcgccacccagaacccggtggagatggagggcacgtacccgctgcccgaggcccagcgcgaccgcttcatggcccgcgtctccgtcggctaccccagccccgaggccgagctgcagatgctcgacgtgcacggcggggtctccccgctcgacgacctgacgtccgtcgcgcactcccacgagatcgtcaagctcatcgaggcggtccgcgaggtgtacgtggccgagcccgtccggcgctacgtcgtcgacctggtctccgccacccgtacccaccccgacctgcggctcggcgcctcgccccgggccaccctgcacctgctgcgcgccgtgaaggcctccgccgcgctcgccggccgggactacgtcctgcccgacgacgtccaggccctggccgccccggtcctcgcgcaccggctcctgcccaccgcgcaggcccagctgaaccgccgcaccgccgagcaggtcgtcggcgagatcctgcagcgcacccccgtcccggccgcgcacgcccgcggcgagatgccgcccggcgcgggcatccggggcttctgatgagcgccggtgccccgcgcggcgccggtggcccgggggacggcggcggactgcgcgcgtcgctgtccgggctgaccacccgcggccgctcgttcctggccgccgggatagccgccgccggctgtgcgtacgtcctggggcagggcgaactgctgcgggtcggcctgttgctcgccctcctgccgctgatctgcgtctacgccctccaccgcacccgcttccgggtctccggcagccgccggctcagccccgggcgggtccccgcgggcggcgaggcccgcgtgcagctgcgcatggacaacgtctcccggctgcccaccggcctgctgatgctccaggaccgggtgccctacgtactgggcccgcgcccgcgcttcgtcctggaccgggtcgagcccggcggccgccgcgaggtgtcctaccgggtccgctccgacctgcgcggccgctatccgctcggcccgctccagctgcgcctgtccgaccccttcggactggtcgagctgacccgctccttcagcacctacgacaccctcaccgtcatcccgcgcaccgagcccctgccgccgatccgcctggccggcgagtccaacggctacggcgacggcagccggcgctccctggccctggccggcgacgacgacgtgatcccccgcggctaccgtcgcggcgacgacctgcgccgggtgcactggcgctccaccgcccgctacggcgagctgatggtccgccgcgaggaacagccgcagcgcagccgggccaccgtcctgctggacacccggcgcctggccttcgacggcgccggccccgactccgcgttcgaatgggccgtctcggcggccgcctccagcctggtgcacgtcctggaacagggcttctccgtacggctgctcaccgacaccggcgactcggtgcccggtgagggcggcggcggtttctcctccggcgggcaggagtccgcggaggccgccgggctgatgatggacaccctcgccgtcgtcgggcactccgacggcgccgggctctcccgcgcctacgacgcggtgcgcgcgggcggcagcggaggcttcgccggatccggcggcgacgggctcctcatcgccttcttcggcgacctggacgacgtacagacggaactggccgcccggatgcgccagcgcacctcgggtgcggtggccttcgtgctggactccgcgagctggggcgggcagcccgctccggggcatgccgtgcccccgctggaggagcggctgcgcaggctgggcgacgcgggctggaccgcactggccgcccggcccggagtggccttcggcgaactgtggcgccaggccgggaccgcacacgtcggtacgggaacctccggaggtcgggaatgagcgggcgggcgaaactgacgctgttcgcggcactggcgacgctgttcacctcgtggtcgctgaaccccctggtggactcgcaggcctggctgctccaggcggcgctgctgctcgccgtgcagagcgcggtgggcgccggcgcccggcgcgtgccgctggcccggaccctgaccgtggccgcgcaggcgctggtgtcgctgctgctgctcgcgttcctctacgccggcaagggcgagtcccacggggacgggccgctggcctacctggtgacggacttcggcgcgctgttcggccagggcctgcgggacgtggccgagttcgcgatcccggctccgctgacggacggcatcaagctgctgctggtgtccggcgtcctgctgatcgggctgctggtggacctgctggcggtgaccctgcgcacggccgccgcggccgggctgccgctgctggcgctgtactcggtggcctcgggcctggcgggcggcggggacgcctcctggttctccttcctgctcgcgggctgcggctacctgctgttgctgctgtccgagggccgtgaccggctcgcccagtggggccgggtcttcggcgcggccccgcgccggggcgccgccgactccggcctcggcaacggggcgggcgggcaggcgacggctcccgtgaagttcgggcggcggatcggcgcggtgaccctgggcctggcactgctggtgccggccgtactgccctcgctcggcggcgggctgctcggcggcacccaggacggcgaggaggacggcggcggcacgggcgggacgatctcggcggtcaacccgctggtctccctgcagagcaacctgaacgcgcaggacaaccgcgtgatcctgaagtaccggacgaacagcccgcagcagggcgagcagtacctgcggatcctggccctcgacgagttcaacggcgtcaagtgggaggcctccgggcgggccctgatcgacgtgccggaggagctgccggaaccgcccgggctccgctccccggtcagcagcaccgcggtggaggtcaccaccagcatctcggcggcggagtactacacccagcgctacctccccatgccgtatccggcgacctcggtgaacataggcggcaagtggcggttcgagccggtcggccggaccctggtcggcgaccagctgggccgcgacaggttccagaacgtccagggcgcggagtacacggtgcgcagcctgctgctgaagccgacggcccagcagctccagaaggccccggagcccgaccccgcgatccgggaggagtacacgaagctcccggacaacctgccgccggtggtcgccgagacggcccgccaggtgacgcagggggcgaaggacgactacacgcgggccgtgaagctgcaggactacttcgccgttaacggcgggttccgctacaacacgcggacggcctcgggcacgggtccgcaggcggtcgcccggttcctctccgacaaggagggcttctgcgtccacttcgccttctcgatggcggcgatgtcccgctcgctgggcatcccggcgcgggtcgcggtgggcttcacgcccggcgagaagcagtcggacggcaacgtgaacgtgtcgatgcgcgacgcgcacgcctggcccgagctgtacttcgagggcgtgggctggacccgcttcgagccgacgccccgctccggcatcaacatcccggactactcccgggcgcagaccccggccacccagccgtccgccccggctccgctgccctcgcagagcgcggcgcagccgtcgacggcgccctcggcgacccccgagtgcccgccggccctgaagaagctcggcgagtgcgacacggcggcgcccgcgcagaacacgagcggtggcgggccgtcagtgccggcgatcctcggctgggcggcgctcgcgctggcggtgctgggcctgcccctgctcccgctgctgtggcggacccggctgcggacccggcgcctggcgaccggggaggtcctgacggcgtggcgggaactgggcgacaccgcctgggacgcgggtgtggtcccggacgaggcgctgtccccgcgccgggcggcgagccggatcgtggacctgggccgcctggagccggagccggcggcggccgtgcaccgggttgcgggtgcggtggagcgggctctgtacgcgcccccgggcgcggaggtctcgtacccggagctggcggacgacgtactgctggcccgtgcgggcctgctggcgtcggcggaccggctgccccggctgcgcgcgctgctgctgccgcgctcggcggcccgtgtctcctgggccctctcggcccgccggtccgcgatcacctcggcggtatcggcccgcctgaccgccgcccgcctgaccgccgcccgcctccggctcccgctgaagggccgcggctagggggaattccggcgcacgatccgccggacccgcggacgcgaaaaggcggtgaggctcgatccccccgagccccgccgccttctcccgtcctgcgtcaccgggccgtgtcccccgtcccggtcacggaaggaggcacccggtccgctccgcagccccgtgtcggcggtgcggaccgggtctcctgtccgttggctcccagtctggcgtccacgcaggtgggagcccatccgcgcacgtactcatttccgcgcctaggtacggatactcagccgccgcggcaggccccaccagttctacggggcggcgcgccccggcggcaccgccgactggggggtggtgccgcgccgcgcctcagcggtttccgctgacccggccccgcagcagcagcgacagcgccgagtgcacgtcgtccagggacctctcgctctggaaggactgccagtccagcgcggccaccaggaccatcccgaccatcgcggccgccgtgagcggcacgtcgatctcggcgctcagctcaccgcgttccacgccctcgcgcagcaccttctccacgacggccaccgcctcctgccggaccaccatgagcgtggactgccacgcgcggttggtgcgccacagctcggcgacgtacagctgggtgaaggccggataccggtcgatgaagacgagtcccgcgcggatcatcgcgtcgagcgcctcgacgcggctgccgccgcgggcctccgtctcctccgcggccgtccgcagcgaggccgtcagcaggccgacgccgtgccgcagcagttcctcgaagagttcgttcttgctcgcgaagttgtagtagacggtgcccttcgcgacgcccgcccgttcggcgatctcgtcgaccgtggtcgcggagaagccctgctcggcgatcagggtgaccgccgcttcgtagagcttctgccgggtgatcgcacgacggcccccgccggtgcccgtaccggtgctgctgctttccatggcgctgattgtcacaggtcaacacgtccctacagactcagttccgggtgcagccggtccatggtccacacctgcttgccgcgggcggcgagcgcggtgagggccagggcgcccgcggtgaaggccaggaggaccgcgcttccgtgccagaccggggcgaggtcgccgccggtgatgaggcggcgcaggctctcgacgatgtacgacatcggcaggtacgggtggatccagttgaagaagtccgggctggtctggacggggtaggtgccgcccgccgaggtcagctggagcatcaggacggccagcaccaggatgcggccggcggcgccgaacttggcgttgagccactggacgatcgccgcgaagcagcaggtgaccagcatcaggaagccgatggtgagggccgggtgggccatcttcaggccgaggccgggcgcccagtgcagtacggacatcagcagggccacctgcgccgtgccgaggcccgccacgggcagccagccggcgagggcgacccgccagggcgcggctccggcggccagggcgcgccggttcatcggggcgatcagcatgtaggccaccatcgcgccgacccagagggacagcgggatgaagtagggggcgaagccggtgccgtagttgggcgccttgtgcagggactggttggcgagctggatcgggtcggccatgacctgggtgcgccgctcgcgctgctcctggtcgtagtcggggatcttgccggcgccctcgtgcaggccgccggcgagctcgccggtgccgtcgacgagcttgtacatgccgccgtcgagccggtgggcaccgtcgccgagcttgccgacgccgtcgctgagggcgccggacccggtggtggcggtgccgaggccggtgtgcagctgggtcatgccggcggacaccttgtgggcgccggagttgagggcgttgaccttggcgacggccgcgtcgaggtcacccgcgagctggggggccttgacgacgagctcgcgggccttcttctccaggtcggtgagctgggtgcggagcttggcgacgtccccgtcggcgttcttgaccaggacgctgacgtccccgctgagctcggcggcctcggccgcgctgtccctgaccttcttcaggtcggggcaggaggccaggtgcggttcgccgccgggggtgacgcagtgcttggtgtagtacgcgtccgcgccggtggcggccttcttcgcggcggcggccgcggccggtgccttctcggcgaacgtccccaggtggttgttgaccaccttcgcgctgtcggcgacgagttcggcggtgtccgccaggttcttcgggtccttgacgaaggggcgggccttgtccgcggccccgttgaccttgtccgccagcgcctgggtgccgtccgcgacgtccttggagccggtctccagcttgccggccgccgtgttcagcttctgcagaccgctgttgagctcgccggacttctcctgcgccgtgtcgaggccgtcggcgagctccttggcgccttcctgggccttgcccgcgccgtccttgagcttgtcggcgccgtcggccgcctcggcggtcttgtcgtgcaggtcggagaagttcacgaagatcttgtcgaggaagccgcgggaggcgttagcggacgccgcggagcggacctcggagaagacggtgcgcgagatcgagccgacgatgtagttgttggcgtcgttcgtgcggacctggagggcgccggtggtggggtcgtcgccggcgctggaggcgatcttcgcgctgaagtcctccggcatggtcagggtcaggtagtaccggccgtcctccaggccctcggccgcctccttcgcactcacctcccgccagtcgaacctcttgctgtcgtgcagcttccgggtgatctcaccgccggcgtcgaggcgcgcgccgtcgacggtcgtgcccttgtcggcgttgacgatggcgacgggcaccttgtcgaggcgcttgtaggggtcccagaaggaccacaggtacagggctccgtagagcagtggcagcacgagcagcgcgacgagggcggcccggggcagcctcccccgcccgaaccgcttcagctcaagcgcggccagcttcggcgagcgcatcgtccgcccccttcgtgtcgtcgttcccggagtcgttcttcgtgtcgttcttcgtgtcgttcttcgtgtcgttcccggcgtcgtcacccgcggcggcgggcgcgtccggctccttgggggaggtccgcaggacgaccgcgtcggcgggtgcctcgctgcacaccgcgaggacggtgatcccgcgggaggcgacggagcggagcagctcccaggcctcggcgcgcgcggtgtccgacagcttgaggtcgaggtcgtcgagggccagcagtcccggggagcccagcagcgcgatggcgacggacagccgtacggcctccaggcgttccaggtcccgtacggaggtgcgcccgcccttgggcagcgtggcgaggtccagtccggcggcctccagggcggaggcgatccgcgcctcggcgacggcgcggcgctcggcccggggccgcagcagggcgcggaccggggcgccgtagtggcgctggagcagggcgccctcgcgcagctgttccgcgacggtgagcgcctggtcgagttcgttgaccccggagaccgggccgagtgcggcgatccggcggaccgccgtcatgtgcttcggcagccggtggccgccgacctcggcgtggccccgggtgggtttcatccgcccggtgagggcaaggagcaggcaggtacgaccgctgccggaggggccttcgaccgcgatgagcgagcctggcgccgcatcgacggcgactccctggaaggcccagccccgcgggcccttgagtccgaagtccgcggctttgacggccgcgccgtgcgggctgtccacgccgtcccccttctttttgaactgactggtcagttcaaaaactagcacccttcttcgcacgaggtgcgcaggagggggcagttgcccggttcgtgaccgtaaaagcgcaggtcagcgcaattgtcagtggggcccgtcacgatgggggcaacgcatcgacaggaggttcgtcatggccacaccgtccccgtcccctgtccaccccgtcctgcgcaagtcgacggccccaccggccgccctcgacctgctggccaaggcccacagcggcctggccgaggccgcccggctgacccgccccaacgagcgctacgccaccgcccacctcgccgccctgcgcaccgccgccgccgtgctcgccgcgcgggcccggccggaaccggtgaacccgcggcgccggccccggatccgcagcgcgtgggaggtcctgccggagctggcgccggagctggcggagtggagcgtgctcttcgcctccggcgccgcgcgcagggccagggccgaggcggggatagcggacgcggcgagctgccgggacgccgacgatctggtgcgggcggcctcgatgttccttcgcctggtggagcggatgctcaccgtccgggccgcgccccagcccctgccgcagaccctgccgcagccacgtccggagcatccggacgcgggatgagctgcccggcggcggaaggcaatagggtgggccaggaccgctcaccctttaccccgccgaggagccatcagccgtgtcggacacttcccgcccccgcgcctccctccgcaccgccgtggtgtgggaggtcctcaaggaggcgctcgaccgccgggtgaaggcgaccgggcgggatgtgctggacgtgctcgacaccggtggcggcaccggcaagttcgccgtgccggtggcccgtctgggccaccgggtcaccgtggtcgaccccagtccgaacgcgctgttcgggctggagcgccgggtcgcggaggccggtgtcgccgatctcgtgcgcggggtccagggcgatgcccagggcctgttggacgtcgtcgagcaggacgcctacgacgtggtgctctgccacggcgtgctggagtacgtggacgaccccgcggagggcgtggccaacacggtggccgcgctgcgcgccggcggcacgctcagcctgctggccgccggtctcggcggggccgtgctggcccgcgcgctcgccgggcacttcaccgaggcccgtacggcactcaccgacccggccggccgctggggctccggcgacccggtgccgcgccgcttcaccgccgagcagctctccgagctggtcggcggcgccggcctcgcggtcggcgcggtgcacggcgtgcggatcttcgccgacctcgtgcccggcgtcctcgtggacaccgagcccggcgccgtggaggccctgctgcgtctggaggaggccgcggccgagctccccgccttccacgcggtcgccacccagctgcacgtcctgggcgagaagcacgcctgaactgcgaccttccgcgcgcggagtcggccacacaccctccgatccgccggtcggccccgtatgatcaggtgcaagaccggcatggtggacggaccattggggaataagggcctcagtgaccgcccccgcggcggtacggttttcacgcaggcttttaccggctgcgtcatttctgggccgtgtcctatgggaacgcgacgcagagggcgggtgtcacgggggcgattccccgcctatcctgaaggggacccctggtcgccacccccgcgaccgacggatgaggaggactcccgtgccgctctcggagcacgagcagcgaatgctcgagcagatggagcgagcgctgtacgccgaagatcccaagttcgcgacagcgcttgagggaagcggactgcgtacgtacacccggcgacgggtctaccaggcagtcgcaggcattgtggtgggtatcgcgctcctcatgaccggtgtgatcattccgaacgtgctctggatcagcgtggtgggtttcctcgtcatgctgggatgtacggtcctggtggtcaccggttggcgcaaggcacccaagcctggcgagcagcccgtctccggaagtaccggtggttcggcccatggccggaaccggcagcgtcggtcgatgatgacccgcatcgaggaacggtggcagcgccgccgtgacgagcaggggcagtagccccggacaacgtgggtgaggggatggccgccgtgcggccgtcccctcacttttctgcgcatccatacggcatgatgatccgatgagtgtgctccccctggtcttcaccagcggctgggccagtgggatcaacgcttacgccgtggtcctcctgctcggcatcttcggccgtaccggcctgaccgacgacgtccccgcctcgctgcaacgcacggacgtgctggtcgtcgcggcggtgctgttcctgtgcgaggcgatcgccgacaaggtcccgtacatggactcgatatgggacaccgtccacaccgtgatccgcccggtgtccggcgcggtgatcggtgcgctgctggccgggcagagcggttcactctccgacatcaccgccgccgcggtcggcggctccaccgcgctggccagccatttcgtcaaagccggcacccggatggcgatcaacacctcccccgagcccttcaccaacgtggggatgagcatcgccgaggacctcggcgtggccgggctcgtcaccttcgcgatgttcaaccccgaggccgccgcgatcatcgcggccgtgctgctggccgccggactggccatactgatcttcctctggagccggatccgccgcttcctgcgccgccgcgcccagcgccgcgaggagaagcggctggcggccgaggcccgcgagaccaccggggccccaccccgctgaccgcagggccaccacggggctcgataggctcggccgcatggcacgaattgcggtgatcggcgccggcatgggcgcgatggctacggcggcccggctggccgttgcggggcaccaggtgacggtgtacgaacgcgggacgacctacggcggagccgtcggcaggtacgagcgcgagggcttcgccttcgacaccgggcccgggctgctgcacctgccggccgtctaccgcgacctcttcgtgaagaccggcaagcggtcgctggagacctgcgtcgacatggtccaggtcgacccggccgtccggcacctgctcccccgccacggcatcgacgtcaccctccccggcgcctcgcgcggcggtgtggccgccgccctggaatcctccttcggcccgggcgccggcgaacgctggaacgccgtcctgggccgggcccgcgacgcctgggacgccacccgccgcccgctgctggaggagccgctgcggcccggcgcccggcaggccctgggcgtcgacccgtacccggccctgcgccgcagcggcctgctgcgccgccggaccccgaccctcgccgaggtggccgaccgggagctgggcggcgcgctcgcggagctgctgaccggcctggtgcgcgggtacgggatcgaccccgccaccgcgcccgcctcggcggccgtgctcccgtacatggaacagaccttcggcagctggtacgtacgcggcgggatgcgcgccctggccaccgccgtgtacgagcgctgcctggagcgcaaggtcgccttcgtcttcggggcggacgtccgggaggtcctggtcacggacggccgggcggccgggctgcggctggccgacggcggtgaggtggccgccgacaccgtcgtgtgcgggatcgacccccggcagctgccggccggttcgctgccgtggccgccggaggcggtccccgcgcgcggggacggcgtaccggggcggatcacgctcctgctcgcgctgcgcggcgcccgccccgccacggccgtgcaccgcaccctggtgcacgcctccggggcgcaggtcaccgtcatgcgcccggacgacccggccaccaggcccgacgaggagcacgaggcggtcaccgtgagcgccgtgcccgggcccgggacctcggaccccgccgagctgctgaacctcgcggagaacgccgtccaggggctgcgggagcggctgttgtggcaggaggtgcgcaccgcggccgacgtcgaggcggcgaccggtgcgctcggcggcgcggtgcccccgcccgccctcgcgggggccgggggccggctgctccagccggccaacaccacggccgtgcccgggctgtacctggcgggcggctgggcccaccccggcggcgggctggcgcacgccgggatgaccggggccctggtggccggactgatcgtggagggcgcggagttccgcggctcccagtgagccgtcagtagcggtactgctcgtacccgccctgctgggggtacgggtactgctgcggcggctcgccctggtcctccatcgggtaggactggccggccccgtcggtggaccgctgctgcgggacccagacgccgccgggcggggtgtccgtggagtactgctgctgcccgtagccggcgtacggcgtgtagtcgtacgccgggggcggggccattccgccgccggtgccgatgtacgggtccgagtaggccgcgtagacctgctgctggtcacccgtcgggtagccgcccgagtagtcgtagccgccctggttctgctggtcgtagtacgccgcgtactggtgggcgtcctgctcggccgtggtgaacggcgaggcgaaggcggccgtccggtcgacctcggggggcgcgaaactctgtatcccgtaggacccggtgtcctcgggcacgggctccgggctgtagacgtccgggggcgcgtcccggaacggccgctcctgcgcggctccgtcctcggccgcggccgcgtcctcgtactgcagcgcggtgacctggagggccggctcctgcttggagcccgcggcccggcggcggcgtgtctgccggacgggctccccgccgcggcgcagcgcccagccggcgacgaagcccttgcggaaggacagggtcaccagggtctggcccacggcgaacgccagcgcgccggcgccgatgaccggcaccgacggcagtatcaccccggcgaccacgccgaggaagccggcgaaggcgagcaggcgccagcggagccgggccttgtactgcatcaggacctcggcaagcagccacagcgcgacgaaaccgaacgcgatgtagaggaccgtcattcccatgcatggcccctctcggtacggccgccggcgcgggaacgggggacggccgctcaggcccgctggtgcaggcccaggttctcgtagatttcgagcgtcgccgtggaattgttgagcgtgatgaagtgcagccccgggacaccctcggacagcagtcgcgcgcagaactccgtggcgaactcgatgccaatggagcgtacagcggccgggtcgtccttgacggcgagcatgcgctctttcacgtccgcggggaagagcgcggtgctgagttggggcagtcggtcgagctgcttgatacccacaacaggcatgacctcggggatgatcggggtctcgcagcccgccttctcgacgctgtcgcgcagccgcagataattctcgggatcgaagaacatctgggtgatcgcatagtccgcgcccgcacggcacttgtccacgaagtgccggatgtccgtatcccagtcggtggatcgcgggtgcatctcggggaaggccgcgacgccgacgcagaagtccccggactccttgagcagccgcaccaggtcggcggcgtagtgcacgccctcggggtgcgccacccagtcggccatcgggtcgcccggcgggtctccgcgcagggcgagcatgttgcggatcccggcgtcggcgaactggccgatgacgtggcgcagctcggcgatggagtggtccacggcggtgaggtgcgcgacgggggtgagggtggtgtcggcggcgatctcctgggtggccttgacggtgccgccgcgggtggagccgccggctccgtaggtcacggagacgaaactcggggataccgcctcgacccggcgcagggcgttccagaggttgcgttcgcccttctcggtcttcggggcccagaactcgaaggagtacgagcggccggacgcgaggaggtcacggaccgtgtgtgcgcgatccgaccaggtggaagcggtaccagaggccatgtgggcaggttagacgcggcccggcggacgccgaagccttgtccacgttttggacacgtttttggacacttggagtgcgcgctccggccggaaggcggccgtacgggtgtatgcggaccgccctccgtccgggcggcgggactcagccgaggcgggcccggacccgcttggcgagctccgcggcggccgcgccggggtcggtggcctcggtgagggcgcggacgaccacgatgcgggtggcgccggcgtccagtacctcgtccaggttcgatccgtcgatgccgccgatggcgaaccaggggcggtcctgctccagcgatgccgcgtaccggaccaggtcgaggcccggggcgtggcggccgggcttggtgggggtgggccagcaggggccggtgcagaagtagtccacgccggcttcggcgacggccgcgtcgacctcgccctcggcgtggcaggaccggccgatcagcacccgctcgccgaggatggcgcgggccgcggggacggggatgtcgccctggccgaggtgcaggacgtcggagttgatggcatgggcgacgtcggcgcggtcgttcacggcgaggagcttgccgtggcggcgggcggcctcggcgaagacctggaggtgttcgagctcctcccccgcctccatgcccttgtcgcggagctggacgatgtccacgccggaggagagcacggcgtcgaggaactcggggaggtcaccctggcgcctgcgggcgtccgtgcagaggtagagccgggcgtcggacagctgcatgggtggtaccccccgtgatggaggcggtgtacgggccggggcccgtacaccgctgtggagcgaaggcgatcaggtcagagggcgagcgcctgagcgcggcgcttcacctccgtgccgcgattctcactcagcgcctgcacgggggtgccgggcagggtcggatcctcggtgaagagccattccaggatctcctcctcggtgaagcggtcgtcgcgcagcacggtcagcagaccgacgaggcccttgacgaccttgtcgccgtcgatgaagggggccggcacctgcagggagcggttctcgccccggcggacggcgatgagctgcccttccttgaccatctggcggacccgggtcacctcgatgtccagcatctccgcgatgtcggggaggtacagccacgaggggacaagggcatcgatctttgcgtcaatctcggtcacaggcacaagcctgccatctcggctccgccgccggtacctgagcagccccgtccgggtcgcggggccgagccgtcgggcggtggccgtcaggcggtggcgtcaggcggtggccgacttcagcggggtcccggggtcggcgaccttggcggggtccacggggacgcccgtctcgatgagcttgcggccctgcgccaggtcgcgcggacggcccacggccaggacggcgaccagcgcgccgtcgcgcagccagcacaccgaccaggcgggacccgccgggtccccgcgcaggagcagggtgtcggccccgccgtggtgtccggcgtactgcacgaagcgcccgaactgctccgaccagaagtacggcaccgggtcgtagacctgggccggctccccggccaggatgttcgccgcgaccgtccgcggcccctggagcgcgttgtcccagtggtgcacgagcagccgcgtcccgtaccgccccgacgggaaggaggcgcagtcgccgaccgcgtacacgtcgggcagcgaggtccgcaggtacgcgtccgcggtgaccgagccgtccgggccgcgttccacgccggtcccgtccagccatccggtcgcggggcgcgcgccgatgcccaccacgacggcgccggcgggcaggacccgtccgtccgccagcaggacccggccctcgtcgaccccggcgaccttggccccggtgatcagctccgcgccggcctcccggtaccagcgcgccatcggctcggtgacctcggcgggcagcgcgcccgccagcacccggtccgccgcctcgaccacggtgacctcgcagcccgcttcccgggcggcggtggcgaactccgcgccgatccagcccgcaccgacgaccacggcgcggggcgacgcggccagcaccgggcgcagccgggcggcgtcgtccagcgtgcgcagcaggtggacgcccgggacgccctcggtgccgggcagggtcagcggctgcgcgccggtcgccagcacgaggattccgtacgggaccggtcccgcctcggtgtccagctcgtggacggcggcgcgcagtccggtgacctccgtgccgagcctgaggtcgatgtcgaggccttcgaagtccacgtcgaaggcggagtcctcggccttgccgaggaggaccgccttggacagcgggggccggtcgtacggctggtggggttcggctcccagcagggtcaccgggccggtgaagccctgttcgcgcagggcgaccgcggtctgcaccccggccattccggcgccgacgatcacgacgccgcgctgattctgttccgtctgctcgctcacgcggccagcctaatcatctgacgctccgtcaggaataggtgccgccttacccgccctccacgaccgggttagtctggccaccgtacctatcgcgggagtccggcgcaccgggctgagagggaggctggccggcctccgaccgtacgaacctgatccggatcatgccggcgaagggaggggctggacgcccatgcactcatctcggaagggttccgccacgggatccgacgtcctcgtcatcgggggcggaatcatcggcctggtcacggcctggcgggccgccgagcgcggcctgagcaccgtactcgccgacccggcacccggcggcggcgccgcccaggtcgcggccggcatgctcgcccccgtcaccgaactgcactacggcgaggaagccctgctcggcctcggcctcgcctccgccgcacgctatccgcagttcgccgccgagctcgccgaggcgagcggcggcctggacatcggctaccgcgcctgcggcaccctcgccgtcgccctcgactccgacgaccgcctccacctgcgcgaactgcacgccctccagcgccgctgcggcctggagtccgagtggctcaccggccgcgagtgccgccgcctggagcccatgctcgccccgggcgtacgcggcggcctgcgcgtcgacggcgatcaccaggtggacccccgccggctcgcggccgccctgctggccgcctgcgaacgggccggcgtcaccatccaccggacggccgcggagcggctgctcaccacccgcgaccgggccacgggcgccctcctcggcgacggtacggaactgctcgccgaccaggtcgtcctcgccgcgggctcgctcaccggccggctggcgggcgtaccgccggaggtcgcggcccccgtacggccggtcaagggccaggtcctgcggctcacggtgccggcggcgtacacgccgttcctgtcgcggaccgtacgcgccgtcgtacgcggcagccacgtctacctggtgccgcgcgagaacggcgaactcgtcatcggcgccaccagcgaggaactcggctgggacaccaccgtcaccgcgggcggggtctacgaactcctgcgcgacgcccacgaactggtccccggcatcaccgaactcccgctcaccgagacccgggcgggactgcgccccggatcccccgacaacgccccgctgctcggcccgaccgacctgccgggcctgcacctggccaccgggcactaccgcaacggggtgctgctgaccccgctcaccggcgaggtcctcgccgagctgctgaccaccggcgaactgcctgagatcgcgcgccccttcaccccccgccggttctccgccgaacgtcaggagtcgtacgcatgaccatctccgtcaacggcgaaccgcgcgagatcgcggccggcgcgaccctcgacacggtcgtcgcgaccctgaccaccgccccttccggcgtcgccgcggcactcaacgagaccgtggtcccgcgcgggcagtggccggccaccgtcgtcggcgacggcgaccgggtcgagatcctcaccgcggtacagggaggctgagcgacatggcggacgacctcctcacgctcggcggccggaccttcggctcccgcctgatcatgggcaccggcggagccccgagcctggacgtcctggaacgcgccctcgtcgcgtccggcaccgaactcaccacggtcgcgatgcgacggctggaccccacggtccagggctccgtcctgtccgtcctgaccaagctcggcatctccgtcctccccaacacggccggctgcttcacggccggcgaggccgtactcacggcccggctggcccgggaggccctcggcacggactggatcaagctggaggtggtcgcggacgaacgcaccctcctgcccgacggcgtcgagctgctggacgccgccgagatcctggtggacgagggcttcacggtcctcccctacaccaacgacgacccggtgctcgcgcggaagctggaggacgtgggctgcgcggcgatcatgccactcggctcccccatcgggtccggcatgggcatccgcaacccgcacaacttcgagctgatcacggagcgcgcgacggtaccggtcatcctggacgcaggcgcgggcacggcctccgacgcggccctcgcgatggaactgggctgcgcggcggtgatgctggcctcggcggtgacccgcgcgcaggagccggtcctcatggcgtcggccatgcgggacgccgtctcggcgggccgcctcgccttccgcgcgggccgcatcccccaacgccgcttcgccgaagcctcctcccccatcgagggccgcgccgccctggacccggaacgcccggcgttctgagggggcgtactggtgcccgcgcgcggggccttcgcccccgcgcccccccgcccccgcacggcggctgcccacccgcccgctcggcatcggcgccatccggaccgccctgccgggcgggaccgggagacggtgcggacggaccggcggcgccgtcatgcggggcggtggctgcggaggggctgttccgctggggcggtggtcagtgatgtgtatgggggtttcccgtcagtctcatcgtctctccgtgtcgggccggtccctcaagggcgctcgttcctcgcgtcgcttcgcgatggccttgcggccacctttgaccgaccgacccgccccggaaatccgaagactgccgagaagcccccaaaagaacgagccggtccaggctctaagggacggggtagtcagagaccccctgcccggacgggggtagggacgttcccgaggcggggcccatccagaccccggcccgggtcggggggaagcgccccaaatcgctacgcgctcctcacgtctcagcgtctccaccccgtcctgggctggacataggccgcccacggccccggtccggcactcgacatgcgtccgacgaccggccggggccgggcacaagccgcccaccaggccggtccgctgcccgacttgcgtccgacgaccggacggcgctgggcattgagccgcctcaaatcgctatgcgcttctccgagactgcgaccggcggccggttgggggctgatgagagtctctgaggaggactggcggccgaaacctccactattccgtcgtggaatcgggtcagcaccaacacgacaccagaaaccagcgcccatacaggggcaattggggcaaattagcgacctactggaccacccacatgcgctgacctgcatccacgacgaaatagccgcagtcccacgccttttcaccccaggacgacggtcagacgcagccaaagaggaccccatgacacctgggcgggcgcgcataccgtcggccgccgtcaaaggggagtgcccaagggtcgtgggctgcttatgcccagccgcagacggtcgtcggacgccgagactgggaagtcgctggggatggtgggcggcctatgtccagcccaagacggtcgtcggacgctgagagatgaggagcacgtagcgattggacgcgcctcccccgaaccggtccccggtctgaatgggccccgcctctcggccatccccacccccgacaaggcagggcatctctggccgccccgtcctgatccttgagtgcccggctcgttcttttgggggcttctcggcagtcttcggatttccggggcgggacggtcggtcaagggtggccgtcaggccatcgcgaagcgacgcgacgacgaaggaggagcgcccttgagggaccggcacgacacggagagacgatgagactgacgggaaacccccatacacatcactgaccaccgccccagcggctcccgcacaccgcagccaccgccccaccacccgactccgcccgagcagctcccgccctccagcgccgccgccccaccacccggccccgcccgcccggctcccgccctccggacccccgccccaccacccgaccccgcccggctcccgcacaccgcacccggagccaccgcccccgggccacaccccgccccaccccgcccagctcgcgcccccgcccagctcacgcccgcgctcgcgccgggtcccgcgtcacaggtgcgctgcaaggcgacccgcccggggcgggtggtgtggggcggctcgtagaatcggcgggtggatacgaccctggatgaccctctcgtcgggcgcgtgctcgacggccgctaccgcatcgacgcccgcatcgcggccggcggcatggccacggtctaccgggccgtcgacacccgcctcgaccgggtgctcgccctcaaggtgatgcatccggccctcgccgccgacgccgccttcgtggaccggttcatccgtgaggcgaagtccgtcgcccggctcgcgcatccgaacgtggtcgccgtcttcgaccagggcacggacggaccgtacgtctacctggccatggagtacgtctccggctgcaccctgcgcgacgtgctccgcgagcgcggcgcgctccagccgcgggccgccctcgacatcctcgaaccggtcctcgccgccctcggcgccgcccaccgggccggcttcgttcaccgggacatgaagcccgagaacgtgctgatcggggacgacggccgggtgaaggtcgcggacttcgggctggtccggtccgtcgactcggtgaccaacaccaccggctccgtcctcggcaccgtctcctacctcgccccggagcagatcgagaacggcatcaccgacacccgcgtggacgtctacgcctgcggtgtcgtcctctacgagatgctcaccggctccaagccccacctcggcgggaccgccgcgcaggtcctctaccagcacctgcacgaggacgtcccgcccccgtccgccgtggtcccggggctctccatcgcgctcgacgagctggtcgcgcaggccgccgcccgcaatcccgagctgcgtccctacgacgcggcggccctgctcggcctcacccgagaggcccgcgcgctgctcagcgacgccgagctggacgccgtaccgccgcaggcgcacgccgaggagcgctcgtccgccgaggaccgtacgggcgtgatcccgcgtccggtgtccgcacagcagcccgtgcagcacacctcccgcctggagatgccggccgccccgcccgcgccgcccgcgcaccgccccgccggggcctccgcgcggcggccccggcgcggggtgctgctcgtcgtcgcgggcgtgctgctcgcgctcgggctcggggtgggcgtctggtacatcagctcggggcagttcacgaaggtcccgaacctgctcggcaagaccgaggcgcaggcccgctccgagctgtccgcggccgggctcggggtcaagggcgtggaccggaagttcagcgacgccttcgaccgcgggacggtgatgaacaccgatcccccgggcgggcggcggatccgcggcaacggcgcggtgaagatcaccatctcgcgcggtcccgaggtcgtggccgtgcccaacctgaagggccggcccctggaggaggcccaggccgagctgacgcagtccgggctggcgcccggcatggtgacgcaggccttcagccaggacatcgcccagggttcggtgatcagcaccaatccggcgggcggcgagaagcgggcgcccgacacggcggtctcgctcgtcgtcagcaagggccgcccggtgccggtgccgagcgtgaccgggctccccgcggaccaggcgaaggcgaccctggaggccgcgggcctcaaggtcgcgacggctcccgagcaggtcaacgcccccttcgcggccggtacggtcgccaaccagtcgatcggcgccggcacccaggccgcggccggggacacggtcacgctgaccgtgtccaagggcccccggcagcttccggtcccgaacgtgaccggccaggacgtggacgcggcccgcaaggcgctggaggccgcaggcttcaaggtgaaggtggaccggccgctgatctccttcagcaacacggtcgacacccagtcggtgccggccgggcagaacgcccccgaaggcagcacgatcacgatcaagaccaaggggctgtgagccgtggtgatgcgcaatcccgtgggcgggcacgtccccgtcgccggcggcctcgcctcggtcggcctggcctacgctcgggagatgggggcggaggccgtccaggtcttcgtcgccaatccgcgcggctgggccaccccggtcggcagtccggcgcaggacgaacggttccgggcggagtgcgcggcggagtccgtccccgcgtacgtgcacgcgccgtacctgatcaacttcggctcgcacaccgaggcgacggtggagaagtcggtggagtcgctgcgccactcgctgcgccgcggccgggagatcggcgcgctcggggtggtcgtgcacaccgggtcggcgaccgggggccgcccgcgggaggcggcgtacgcgcaggtcagggagcacatgctgccgctgctcgacgaactgacgcacgacgacgacccgttcctgctgctggagtccacggccgggcagggttcttcgctgtgctcgacggccgaggagttcggcccgtacttcgaggcgctcgaccgccatccgaagctgggcatctgcctggacacctgccacatcttcgcggccggccacgatctggcggagccgggcgggacgaagctgacgctggacctgctggtggacacggtgggcgagggccgactgaagctggtgcacgcgaacgactccaaggagggtgtcggcgcgcacaaggaccggcacgccaacatcggccaggggcacatcggccgggaggccttcgccgagctgatctcgcaccccgcgatggacggcgtaccgctgatcatcgagacgcccgggggccgggaagggcatgcggcggacgtggcgctgctgaaggagctgcgcggcccgcactgatcccccgactccttgaggaataccccaggggggtatacggttccggcatatcgacggaaccgctacccggcgttcccacgagggggttgtcatggagcacgagcatcagcactcgcaccagcaccacggacccgagaaccaccaccacgagcacgcccacaccgcccacgccgcccacaccgtcggcggcccggtcagctggggcatggccgcccgggccaccctccactgcctgaccggatgcgccatcggcgaggtgctcggcatgatcatcggtaccgcgctgggctgggggaacgtgtccacgatgatcctggcgatcgtcctcgcgttcttcttcggctatgcgctcaccctgcgcggggtcctcgccgcgggggtcggcctccgtgcggccatccgggtggcgctggccgcggacaccctttcgatcgccgtcatggagctgatcgacaacggagtgatcgccctgtggcccggcgcgatggacgcgcacctgtcggatgcgctgttctggatcgtcctggcgatcgcgctggcggccgccttcgtgatcacgaccccggtcaacaagtggatgatcggccgcggcatgggtcacgcggtcgtgcaccggtaccaccactgagcgactacagttcggggccctccccgggctcctcctggtacgagtagcgctgctcgcgccacgggtcgccgatgttgtggtagccgcgctcctcccagaagccgcggcggtcggcggtcatgtactcgatgccgcggacccacttggggcccttccaggcgtacaggtgcgggaccaccagccgtacggggaaaccgtgctcggcggtgagcagttcaccgccctcgtgcgtggcgaagaccgtccggtcggaggcgaagtccgacagccgcaggttggagctgaagccgtactcggcccacaccatcacgtgcgtgacctgcggcgcgggaggcgccagggcgaggacctcgcgggcgagcacaccgccccattcggcgccctgcatgctgaacttcgtgacgcagtgcagatcggccacgacggagtcgaacggcagggccgtgaactcctcgtggttccagcagtgcttgtccccgtcggccgtcgcgccgaagacgcggaactcccagcggtccggcttgaacttgggcaccggcccgtagtgggtgaccggccagcccctctgcagccgctgccccggtggaagctccagctgctctgctcccggagattcccggctttccggctgacccatgactccatggtgacagattgggcagggtggtcatgaccaggtccggccctatccgggcaagtcacggcaactcccactaaggaggcacttactggacgctctccggcggcggtgcaaggatgcgcgcaactgccccgtcacatagctgacattgcctggaaggagcctctgcgatgcagggcgaccccgaggtccttgagtttctgaacgagcagctgaccggcgagctgacggccatcaaccagtactggctgcactaccgcatccaggacaacaagggctggaccaagctcgccaagtacacgcgtgaagagtccatcgacgagatgaagcacgcggacaagatcaccgagcgcatcctgatgctcgatggcctgccgaactaccagcgcctcttccacgtgcgcgtcgggcagacgctcacggagatgttccaggcggaccgccaggtcgaggtcgaggccatcgaccgtctcaagcggggtatcgaggtcatgcgcggcaagggtgacatcacctcggcccggctcttcgaggagatcctggaggacgaggagcaccacatcgactacctcgacacccagctggagctcatcgagtccctgggtgagccgctctacatcgcgcagctgatcgagcagccgagctgacgggctccgggaaccggctctaggccgcttccgccagctccgccgagcgggccggacccggctccgcggcgaggacggcagccgcctcgcccttctccagcagctcacggcgcgggcacgccccacggccgaggatgccctggatggtgcgcacgcaggacccgcagtcggtgccggccttggtggccgaggcgatctggcgcggggtgcaggccccgtcggccgcgtgctccttgacctgcttgtcggtgattccgaagcaagagcatacgtacacgcggttcacctcccagggcggaatggttcttcggttcggcgagccatccccgtttcggtgaggcttacctaaccgtacccaaagttagggtggcctaaaagccctggatacgacagtggggcgcggatcacatcgatccgcgccccactgtcgtacgaaggtactgactgatccctactggtcgcggtacatctcggcgacgaggaaggccaggtccagcgactggctgcggttgagccgcgggtcgcaggccgtctcgtagcgctggtgcaggtcgtcgacgaagatctcgtcgccgccgcccacgcactcggtgacatcgtcaccggtgagctcgacgtggatgccgcccgggtgggtgccgagggccttgtggacctcgaaaaagcccttgacctcgtcgagcacgtcgtcgaaacggcgcgtcttgtggccggaggccgcctcgaaggtgttgccgtgcatcgggtcggtgacccaggcgacgatcgcgccggaggcggtgaccttctcgaccagctcggggagcttgtcgcggaccttgtcggcgcccatgcggacgacgaaggtcagccggcccggctcgcgctcggggtccaggcggtcgatgtacgtcagcgcctcgtccaccgtggtggtggggccgagcttgatgccgatcgggttggcgatctgcgagcagaactcgatgtgcgcgtggtccagctggcgggtgcgctcaccgatccagaccatgtggccggaggtgtcgtacagcttgccggtgcgcgagtcggtgcgggtcagcgcgccctcgtagtcgagcagcagcgcctcgtgggaggcgtagaactcgacggccttgaactcggccgggtcggtgccgcacgccttcatgaagttcagcgcgttgtcgatctcccgcgcgagctgctcgtagcgctgaccggacgggctggacttcacgaagtcctggttccaggcgtgcacctggcgcaggtcggcgtaaccgccggtggtgaaggcgcgcaccaggttgagcgtcgaggcggacgcgttgtacatgcgcttcagccgctcggggtccgggatccgggcctcttcggtgaaggcgaagccgttgacggagtcaccgcggtaggtcggcagggtgacgccgtcgcgggtctcggtgtccttggagcggggcttggagtactggcccgcgatgcggccgaccttgacgaccggcacggaggccgcgtacgtcaggacggcgctcatctggagcagcgtcttgagcttggctcggatgtggtcggcggagacaccgtcgaaggcctcggcgcagtcgccgccctggaggaggaacgcctcgcccttggcgacggctcccagacgggcacgcagctggtcgcactcacccgcgaaaacgaggggaggatacgactcgaggtccgcgacgacagcgcgcagagcctcggcatcggggtacgaaggctgctgcgccgcgggaaggtctcgccaggtcgccttggcggcgggggcttgggtttcagcgttcacggtcacctcgtacacattacggcgtcacacgccgcatccggccccccgcccacaacgtgagacgaaccagctcaaaggtcgcggacgcccgacggaacggaatccatggttcagctcgcgtcgtgagacagatcctgccccgcgggggcggtctgggctaaggtggccgccatgtacgcgcactcgaaccagaactggtggtggaccgctcccggcggcccacttctcgcgcgtacctgacgacacgcacgacgcgaaggccgccccgaggggcggccttccgcgtttccggccgtgtggccgggtcccggagccgctcctcccaccggaaggacgctccgccccatgaaccccatccgaccccaccggttgagccggctgctcgaccccgcctccccgccgttcgccctgctgcgccggcggacccccggccgcgaccacgacaccgtcgaggtgctgatcgggcaggtcggcgaggtcgagcggctcgccgacctgcccctcggcgagctgcccaccctcgcgctcgtccccttccggcagatccgcgagcgcggcttcgacgtacgcgacgacggcacgccgctgagcgtgctggtcgccgaggaggcgtacgagatcccgctcgccgaggcgctggccgcactgccggggcacagggtgcgggtcgaggacggcggtttcgacgtccccgacgaggagtacgcggccaccgtccggcaggtcgtcgaaggcgagatcggccggggcgagggcgcgaacttcgtcatccggcgcacctacgagggccgcatcgacggattcggccgggccgacgcgctcgcgctgttccggcggctgctggagggcgagcggggcgcgtactggacgtacgtcgtccacaccggggagcggaccctcgtgggggccagccccgaggtgcacgtgcggatgtccggcccgacggtcgtgatgaacccgatcagcggcacctaccgctatccggccggggggccgaccgccgactccctcctcgccttcctcggcgaccgcaaggagaccgaggagctgtcgatggtggtcgacgaggaactgaagatgatgtgcacggtcggggacaggggcggggtcgtcgtcggaccgcggctgaaggagatgtcccacctcgcgcacaccgagtacgagctgcggggccggtcctcgctggacgtgcgggaggtcttgcgcgagacgatgttcgccgcgacggtcaccgggtccccggtgcagaacgcctgccgcgtcatcgagcggtacgaggtaggcgggcgcggctactacgcgggcgcgctggccctgctgagccgggatccggcgggggcgcagaccctcgactccccgatcctgatccgcacggccgacatcgcggcggacggcgtgctgcgggtgccggtgggcgcgacgctggtccggcactcggatccggcgggcgaggtggcggagacccatgcgaaggcggcgggggtgctggcggcgctcggggtgcggccggccgcaccgcggcccgcgtcgcagggggcccggctggcggacgacccccgggtgcaggcggccctcgccgcccgccgccaggacctggcgccgttctggctgcggatgcaggagcggccgccggccccggccgggcacgcgctggtggtggacggcgaggacaccttcacggcgatgctggcacacgtcctgcgggtggccgggctggaggtgaccgtacgccgcttcgacgacccggggctgcgcgcggcggccctggcctgggagggcccgatcgtcctgggccccggcccgggcaatccggccgatacctcggaccccaggatgcggatgctgcgggcgctggcggccgagctgctggccgggcaccgccacggcctggtcggggtctgcctggggcacgagctgctggcggccgagctgggcctcccgctgatccgcaaggcggaaccggcgcagggggcgcagacccggatcgatctgttcgggaccgaggaggtggtcggcttctacaacacctacaccgcgcactgcgacgaggcgggcgccgcccggctggccgcgacggggatcgaggtgtcccgggacgcggccacgggcgaggtccacgccctgcggtccccgtccggaggcttcgcgggggtgcagttccacccggagtcggtcctcacgctgcgcggcgcggagctgctgcgcgagctgctgaccggtgtcatggccccggtctaggcggtgccgtcggcgggggccggcttcgccttccggcgggaccgggtctcgcggacgcccttccacacgagcaccggcgccatcagggccagcgcgacgagcgggatctccacgtgctcgccggggaaggcgaaggaggtgatcagcaccgtccccagggtgtggtcggcggcgtccagcagccgtccggaccggtggccgggggcggccctgcgggcgaggtgcagcgcccgcagggcgccgaggaaactcaggagggcgagggcgagcagggcccagcgcgccacgacgggtatgtccacgtggccgaatctatcccccgccccggcccgccggcatggccgtgcgccgaagtccgggtgaacgcgcggtgccggtgggctatggcggcgggaccagggtgttctcggagcggcggcccgccaggtggtccgccacgttggcgacggtggtggcgatgatctggcccaccgcgtccgccgtgtagtaggcctggtgggaggtcaccacgacgttcgggaaggtgaccagccgggccagggtgtcgtcctcgacggcctccagggacttgtcgaggaagaagaccccggcctccgcctcgtacacgtccaggccgacgcccgtgaagcggcccgcccggagttcgtcgaccagggcatcggtgtcgatcaacccgccgcggctggagttcaccaggatcgcgtcgtcccgcatccgccgcagcgccgcggcgtcgacgatgcgccgggtggactccagcaggggcacgtgcaggctgaccaggtcggaggaggcgagcagttcgtccttgtccacgtacgtcatgccgagctccaggcaggccgggttctgcaccacgtcccagcccagcaggcgcatgccgaaaccgtgggcgatccgggtgaacgcctcaccgatcttgccggtgccgagcacgccggccgtgcggccgtggaagtcccggcccatcagcccgttcagcctgaagtcgaagtcccgggtccggatcgacgcccggacgatccgccggttcaccgccatcgcgagggcccaggcgaactcggccaccgagtagggcgagtaggcggagacccggctgatcgccaggcccaggcgccgggcctcgtccaggtcgatgttgttgaagccggtggaccgctgggagatcagcttcgtcccgcccgccgccaggacccgcagcacccggccgttcaggtcggcgttcacgctggaggagacgatctcgtacccggcggcgatcggcgcggtgtcctcgtcgaggaagacgtccaggcaacggacctcgtgctgccccgcgaaggcctgctccaggagcggcttctcgtcggcggtcacaccgaatgccaggatctccacgcttgctcccgcacctcgaaccatgggccgtttgtcaccatacggcccatggtggcgggtcgccgctcagccgaagaagaccccggcctccttgtagagcgccggatccaccgtcttgagcttcgacgtcgcctccgcgatcggcacccggacgatgtccgtccccttgagcgcgaccatcttcccgaagtccctgtcgagcaccgcgtcgatcgcgtgcagcccgaaccgggtcgcgagccaccggtcgaaggcgctcggcgtgccgccccgctggatgtgcccgagcacggtcgtacgggcctccttgccggtccgcgcctcgatctccttggccagccactcacccacgcccgacagccggacatggccgaaggagtccagggtgccgtccttcaggaccatctccccgtccttgggcatcgcgccctccgcgaccaccacgatcggcgcgtagctcgcccggaaccgggaggtcacccaggcgcagacctcgtccacgtcgaagcgctgctccgggatgaggatgacgttggcgccgcccgcgagccccgagtgcagggcgatccagccggcgtgccggcccatgacctcgacgaccaggacccgcatgtgggactcggccgtggtgtgcagccggtcgatggcctcggtggcgatgccgacggcggtgtcgaagccgaaggtgtagtcggtggcggacaggtcgttgtcgatggtcttgggcaccccgacgcaggggacgccgtactcctcgtacagccgggccgcgaccccgagggtgtcctcgccgccgatcgcgacgagcgcgtccacctcgtacttcgcgaggttctccttgatgtcccgcacgccgttctccgtcttgaacggattggtgcgcgaggaaccgaggatggtgccgccgcggggcaggatgccgcggacggcggggatgtcgagcgggacggtccgcccctcgatcgcgccccgccagccgtccttgaacccgacgaacccgcagccgtactcctgctcgcccttgcggacgacggccctgatcaccgcgttgagcccggggcagtcgccgccgccggtcagcactccgaccttcatggaatctccaatcgccatgacggtcacgctagtggtgacccagatcacagcaaggggcctggagaggccaattccggtggaattgcgaggcgttgcgtacgcccgttcactcgtacgaggaagtaagtacgatcgacgggcggtgcggacgtcccccgggcgggtactacgcgtcgtcgaggccgcgttctatcgcgtaccggacgagttcgacccgattgtgcaactgcagcttgcccagggtgttctggacgtggttctgcacggtgcggtgggagatgaccaggcgttcggcgatctgcttgtacgacagccccttggccacgagccgcagtacctcggtctcgcggtcggtcagctgcggggccttcggctcgtcggaggtggccggcagcgggtcggtggccaggcgccggtactcgccgagcaccagcccggccaggcccggggtgaagaccgggtcgcccgccgcggtgcggcgcacggcgtcgatcagctcctgggcgccggcggacttcagcaggtagccggtcgcgccggacttcaccgcctccaggacgtccgcgtgctcaccgctggccgacaacaccaacacccggagggcgggattggcgccgaccagctccttgcagacctgcacgcccggcatgccgggcaggttgaggtcgaggaccagtacgtcgggcgtgacggcgtgggcccggcggaccgcctcggggccgtcgccggcggtggcgacgacgtcgaagcccgcggcggccaggtcgcgggcgaccgcgtcccgccacatcgggtggtcgtcgacgaccatcacccttgtctcgtggagctcgttcggcctgttcggatcgttcacgttcacgtcggtgctctcgctcatgttctgttcgtcctccccctgggtaccttcagttccacttcggtgccctgcccggggacggacaccagatcggcgctgccgccgagatcgcgcagcctgccgcggatggacagggccacccccatccggccctcgcccgccgcctggtcgagccggcccgccgggatgccggggccgtcgtcgcgaacggtcacgatgacctcgtcgccccagtcctcgacgaggatccaggcccgagccccttccccggcgtgcttgcgcacgttgtccagggcggcgccgaccgccgcggccagttccttcgcggcgggcaccggcagcggcaccggggtgcccggctcggcgaagctcacgcgggacccggcgtgcggggcgaggagcgtccgcaggtccagctcgccgtcctcggcgcccggctcgtccacctcgtacgcgtcgaccagagcgccccgcgactcgtcgtgcgagacccgggagggctgcaccagcccgctggagaccagcgtgcgcagcgccacctcctgctccccggccatccggccgagctcctcggcctcgccgcccagctcgctgccgcggcgctggaccatggcgaggacctggaggaccccgtcgtggatgtcgcgggcgaggcgctcgcgctcgcgggtcgcggcttcgatctccagggcgcgggcgagggtgttctcactggcccgggcgacctcgaccacgtagccgatggcgacggaggcgacccatacgagcaggacgttgtgcagggtgtcccgggtgggctggcccgtgtggatggcgaggttggcggccgccacgaaggtggaggcgaagcaggcccagcgccagccgcccttgatggcgaaggcgaggaccgcgcccgccgtccagatggtggggagggtggagccgcccgcgtggatccgcgcctgggtgtcggcgaccggggtgagcgcgatgcccgcgatggcgacggtgaggtcggcgacgaggaagcccttggtgcagctcgccgcgttcgccaccttgcgggaggtggcgagggtccagacggcgaggaaggcgaggtagccgaccgcgacgccggggcgcgggaactccttgtacgcggcggcgaacagcagcaccgcgtaggccatggtcagcagtcggtacgcggtcagggcacgccacagcggctgctcgaccgacatgcgtacgacgcgttcgcgtttcgccatctcccccaccccccgcgggcggtaccgcccgcgcgcacctactccgacgtgccgtcggccttggcggtcttctccgccttggcggccttctcggccttctcggcatcggcgatctggcgcttggccgcggtcgcgtagatgtcgacgtactcctggccggagagcttcatgatctcgtacatgacctcgtcggtcaccgagcggaggatgaagcggtcactgtccatgccctggtagcggctgaagtccagcggcttgccgatccggatccccgggcgcatcagcttggggacgaccttgccgggcggctggatcttctccgtgtcgatcatcgcgacggggatcacgggcgcaccggtggccagggccacgcgggccagaccgccgggcttgccgcggtagaggcgtccgtcgggtgaacgcgtgccctcggggtagataccgaacagctctccgcgctcgatgacctggatgccgctctggatcgcggcctcaccggccccgcgggcgccggagcggtccaccgggagctggccgacgcccttgaagaaggcggccgtcagcttgcccttgacccccggggaggtgaagtactccgccttcgcgatgaaggtgaccttccggtccagcaccgcaggcaggaagaaggagtcggagaaggacaggtggttgctcgcgaggatcgccggcccctctgcgggaatgttttcgaggccctccacccacggcctgaatgcgagcttcagtgaaccgccgatggagaacttcattgcgccgtagatcaactcgaaagccttcctgtgtctgtcgaacagaccatatcccgtgcctacaccggcaggggccccgacgaccctggccggtgccaccccggtcgcgtaccttgaagtcacacagagcaacgcacccacccgatgtacatcgtgatcaaggagactctggtgcccgtcctccctggagccgagccgttccgccacgagggcggagaggtcggcgtccttctctgccacggcttcaccggttccccgcagtccctgcgtccctgggccgagtacctcgccgggcggggcctcacggtgtcgctcccgctgctgcccgggcacgggacgcgctggcaggacatgcagctcacgggctggcaggactggtacgcggaggtggaccgcgctctgcgggaactgctggaccggtgcgagcaggtgttcgtcttcgggctgtcgatgggcggggctctgacgctgcggctggcggccaagcacggggacgccatcagcggcatcgtgctcgtcaacccggccaacaaggtgcacgacccgctggccgtgaccctgccggtgaccaagcacctcatccgctccacgccgggcatcgccagcgacatcgcgaagccgggctcggaggaggtcggctacgaccgggtcccgacccgggccgcgcactcgctgaagaagttcctgcagctcgtggacgccgatctgccgcaggtgacgcagccgatgctgctgctgcacagcccgcaggaccatgtcgtaccgcccgtggactccgcgcgggtactggcccgggtgtcctcgacggacgtcaccgagaccctgctggaacagagctaccacgtcgcgacgttggaccatgacgcggagcggatcttcgcggacagttatgcgttcatcggccgactggcggagagcgtgggcagggagggggcggaggccggtggctgagcacgaggagcagtcgggcggggttccgccgctggacgaggaagcggcgtgggcggcgatcgtcgccgggtacggccaggagccgccggacccgccgggggccagaccgttcaggccgatcgagaacctcctcctgccggaggaggacgtcaagccgctgcccgcggactcgggacgggacgcgaaggccgatccgaagccggacaccgaaccggacacgaagccggatccggagcctgaagcggaaccggggcccccggcggcgctgggcagctccgtgctcttcgcgccgggcgtgggcatggcgggtccccgggaccactcgccggcggagccgcaggacgacgacctgacctcggcggaggagggccacttcgtgcccccggagccggagctcccgcccgcggacacgacgtcgaagttcgcgtggctggcggtcgtcggcggtccggtgctgctgctgctcgcggtgctcctgcagtgggagatgacctggtggctgacgacgctgggcatcggcggcttcctgggcggcttcgccacgctggtgggacgcatggcgcacgacggcgaagacgatgacgacgacccgggccgcggcgcggtcgtctgaccccgaggcttcccggggctccgccccggaccccgtgcccccatcgccggcggggctgaaagagagccccgccggcgagtgaggcgcggtccgggggcagcgcccccggctacggcgcggccgacagccgcagggccgccagcaccggcaggtggtccgtcgccgaccgcaggtccgtggccgagacgcccggcagccccgcggggaccccgcaggccagcacctcgacccccttcgtggcgaacacggcgtcgatccggcggtccggcgccgccgcggggaaggtgggtccgccgccccacggggccaccgcccggcagtcctggagcccggcggccagcagcccgtacgcgggcccgtccgggccctcgttcaggtcgcccgcggcgatcgcgtacggcacgtccatgccggccagccggtccagcagcagctccgcgtgggcccgccgctccgccgcctgcagcgagaggtgcacggaggccaggcccagccgcacgcccccgacccggatcaccgccgtggcgaagcccctgcggtgcaggccgggggtgcgcggcagcaggacgtcctccgtgcgctccacgaagacgcgcagcgagcacagcagcagcggcccggccgccgtcgcgccgccgcccagcaccaccaggtcgcacttggcggccagccgcgccgcgtgtttgcgccatcggaagaaccggggggcctcctggacgaggacgaggtcgggctcgcacgcccggatgacccgggccagcgcctcctcgtcgtcgcgcagggagcggatgttgtagctgagcacccggatcacggcagaaccgtcgggctccgtacgggacttcggcagctggtccatgacccgcaagatacgcagccgcccgccgctcccccaaggggcgcggcgggcggcgggcagagaaagaagggtgaaaagaggtcagccctggcgggccaggtcggccgcgccgacgagcccggccttgccgcccagctgtgcggcgaggacctgcgcgtgcggacgccacgcgccgccgaccagccagcgcttgaaggacttgcggatcgggtcgaggacgaggtcgccctcgtccgagaccccgccgccgacgatgaaggcggacgggtcgaacagcgaggccaggtcggccagtcccgcgccggcccagcgggccagttcgcggaaggcgtcgatggccaccaggtcgccctgcctggcggcctcgctgatgtgcttgccctcgatgccctcgggggtgccgtcaccgagcgagagcaggatcgccgcgttctcgggggtggcgttggcgcgctgcttcgcgtaccggacgagcgcgcgccccgaggcgtactgctcccagcagccctggctgccgcagccgcacagcaggccgtccgggacgacccggatgtgcccgaactcggcggcgacgccgaagcgtccgcgccgcagcttgttgccgatgatgatgccgccgcccaggccggtgccgagcgtgatgcagatgacgtcgtcgtgtccctggccggcgccgaagcggtactcgccccaggcggcgcagttcgcgtcgttctcgacgacgacgggcaggccgatgcgctgctcgaccttgtccttcagcggctcgtgccgccagttgatgttgggcgcgaacagtacggtcgcgcgcttgtcgtccacgtatccggcggcgccgatgccgacggcctcgatggtgtggttgctgctgacctcggagacggcggcgcagatggcctccgtcactccgtccgcggtcggcggggtgggcaccttgtacgtctcaaggatcgtgccctcttcgtcgaccacgccggccgcgatcttcgtgccgccgatgtcgacgccgatggtgagtcccattagtccctcggtttccggtcaaaccccgccacggcccacggtacccgaggcttccggaggatcagtcgagatcgatccgctcggaggggccgtcgtcgggcccttcgtcacgcgggtcgcggtcgtgggacgcctgccggggagccgggggttcgccccgcgtccagcggcgctcgtggccctcgacggccgaacggtaggcggcgagcagctcggagccggcggccgcgaggtggtcgaagacctccggattgcgctcgatgacgggcttggcggcggttttggcctggtcgacgatctggcgcaccgcgccctgtgcggccgcgccgagcagcgggttgttcagcccggacaccttgtcggcgacggcttcgaagagcttgaacagctcctcggcggcggtgccggtgccgccggccgcggcctgctcctgtccgcgccggcgttccttctcggcggcgaggtcctcggcacaggcgctggcccaggcgtcgtcgtcggcgggacggtcggtggcctcgctcatggcggactctcttctgcggctgctgcggtgcgtgcggtacggactaccttcgacggtacccgaacgggggtacgcggttcatcgcgtacggggccacagtcccgggtcgggggtgaagcggatccgcagctccccctgggcgagggcggcgccggagacggtgcagcggcgcagcgcggcgggcagcggaacgatcctgcggtgggggccgacggtgagcagcagctcgtctgcgcggcggacgaggtcgaggtcgctcttgtgcgcgccgggcagcggtaccacccagacgagcaccccgtcctcggcgagccggtcctccacggcccaggcccggcggggtgcgggcgcctcgggcacgagcccgccggtggcggcgagctgctccaggtcctgcgggccgcgcgggtcccggccgaggtgggcgagggtcacgacggggagctcggccgcccactcggcggtgtacttctcctgctgggcggcgagcccggcgagccaggggtcggcggattccactggcacggtgcggttggcgacgacggcggagacgggcagctgctggagggcgagtccgagccggccgaggcgcagcgcgtcggcggcggccgggccgggctcggcgaccagccgcagttcggtggtgtcggcctcgacgacggcctggacggcggccagctcctcgtcccagcgggcggcggtctcgtagagccactgcgcgggcatggggacgccggccagctgggccagtacgggccgcagggcgcgggcggcctgccgctcggcgggcagcagccgggcgaggtagcggcgcagctgggcggggagtgcgagggtggccacgctccggtggagcggcggcatgtcgacgacgacgagatcggtgccgggcgcggcggcggcccgccgcagggcgcggagcagggcgaactcttcggcgccgggcagttcggtgatctcctcggcgtccaggggccgggccccgaccatgccgagcagggcggatccgcgctgctggagggtgacgagctcgtcgcggaactcctcgccggagtccacccgggccacccgcagcccgggggcggccgggtccccggccagggcggtcagcgggtcgccgacgtcgccggagagcagcagcacccgccgcccctggcgggccgcggcgagtgcggtggccgcggccacggtggtccgcccggccccgccggggcctgtgatcagcaaggtgtgcatgtgcgggtgctccgggtcggtggtggtccgtggccgcgcgcctgcgggcggtgggcccggaagggcgcgcagcgtgttccccggcccctccggcgcgcgggaagcggggtcagacgctttcgacgcgcttcttcaggcccgcgagcgcacggtcgatgatgaccttctcggccttgcgcttgatcatgccgagcatggggatcttgacgtcgacggtcagctggtaggtgacctcggtccgcttgccgccgtcgacggccgccagccggtaggagccgtccagctggcgcagcatctgggacttgtccagggtccagctgacctcgtcggtgcccttccaggtgtaggcgagggtgtggtcgtccttgatcgcgcccgcgtcgagcagcaggcggaccttctcggcgcgcccttcggcgtcggtggccagtacctcggcctccttcacctcgccggtccactcggggtaacgggcgaagtcggcgatcacggccatcacgtcggtgggcgcagcctcgatcgtgatgcttgagctggtgtgttccgccatcgcggtcgctcctccgggctgggggtacctcccagcggcagctgggggagttcgaggatgtgtgcggcctggggccgccgcgtgaaggctaccgcgcgtgtggacgtcgccactccagtggctcccggaccctgccggagcccgccgtgaggcggctcgatccctaccattcgaggacccagggccggccggtcgccgcgaagtggcccacgttcacgcactcggtgttcccgatgcgcatgcggcgggccagcggctggtggacgtgtccgaagagggcgtagcgggggcgggtgcggcggatggcggcgagcagggcctcgctgccgcgttcgaaccggcgggcgacggtgtcgtagcagagctcgggcacttccggcgggatgtgcgagcagagcacgtccacctcgccgagggcctccaccttggcggcgtactcctccacgtccacctcgtacggggtgcgcatcggggagggcagtccgccgccgacgaagccgaagacccggccgccgatctccacccgctggccgtcgagcacggtgatgccgtcgcggtcggcgtactcgggccacaggcccgggacgtcgacgttgccgtaggtggcgtaggtgggggtggggaaggccgcgaacatctgtgcgtactggcggcgtacggcgccctcgatgagggtgtcccggtccaggccggtccagagctgccggccgaaggcgtgggcctcctcgaagcggcgcgcggtgcgcagctcgacgatccggtgggcgttctcgacgccgaacagatcggggaagatccctcgggagtggtcggcgtagtcgaggaagagcacgaggtcgccgaggcagatgagggcgtcggcgccgtctccggcgcgggcgagggcctcggtgttgccgtgcacgtcgctcacgacgtgcacccgggtgcggcccggcccatggcccggtccacggcttgatccgctcgcgccccgctgctgtccccgcatgctgccagccatgcgccccaccctagagctgcctggtggcggcgggtagagggggtgggaagggtggccggacctgcggttacttccgagtcgccggacgggtcgactactgtcggcacgttatggcgaagcagggtaagtgcagaatgtgacgcacggaacatctggccggttccccctatcgggaacccactaccggtgggtaacgtccggtcggtccacatggtggcgatggcgcccagaggagcagcagtcttgcgcgagttcagccttccggccctgtacgaggtcccgtcggacgggaacctgacggatctcatccgccgcaacgccgctcagcatccagacaccgcagtcatgagccgcaaggtcgacggccggtggcaggacgtgaccgcgaccgagttcctcgccgaggtccgcgccgcggccaagggcctcgtcgcggccggcatccggcccggcgaccgggtcgccctgatttcccgcacccgctacgagtgggtgctgttcgacttcgcgatctggagcgcgggcggcgtcaccgtccccgtctacgagaccagctcccccgagcaggtccagtggatcctcggcgactccggtgccgtcgcggtcatcgtggagagcccggcgcacagcgcggccgtggcctccctgcgcgaccggctgccggagctgcgcgaggtctgggagatcgagcagggcgcgctggagacgctgaagaccgccggcgcggagatctccgacgccgaggtcgaggagcgcagcagcctcgcgaacgccgacgacccggccaccatcgtctacacctcgggtaccaccggccgccccaagggctgcgtgctgacccaccgcaacttcttcgccgagtgcggcaacgtcgtggagcggctgagcccgctcttccgcaccggcgagtgctccgtcctgctcttcctcccggccgcgcacgtcttcgggcgcctggtggaggtggcggccgttctggcgccgatccgcctgggctgcgtaccggacatcaagaacctgacggacgagctccagtccttccggcccacgctgatcctcggagtcccgcgcgtcttcgagaaggtctacaactcggctcgcgccaaggcccaggccgacggcaagggcaagatcttcgacgccgcggcggacaccgcgatcgcctacagccgcgcgctggacaccccgggcggcccgtccttcgggctgcgcctgaagcacaagctgttctccaagctggtctacagcaagctgcacacggtcctcggcgggcgcggcgagtacgcgatctccggcggcgccccgctgggcgagcggctcggccacttcttccgcggcatcggcttcacggtgctggagggctacggcctcaccgagtcctgtgcggccacggccttcaacccgtgggacaagacgaagatcggtacggtcggccagccgctgcccggctccgtggtgcgcatcgcggacgacggcgaggtgctgctgcacggcgagcacatcttcaaggagtactggaagaacgagtcggcgaccgccgaggcgctgaccgacggctggttccacaccggcgacgtcggcaccctcgacgaggacggctacctcgcgatcaccggccgcaagaaggagctcatcgtcacggcgggcggcaagaacgtcgcgccggccgtcatcgaggaccggatccgggcgcacgcgctggtcgcggagtgcatggtggtgggcgacgcgcgccccttcgtggcggcgctggtcaccatcgacgaggagttcctcgtccggtgggccgcggagaacggcaagccggcgggtgtgacggcggcggagctgcgcgaggacgcggagctgatcgccgccgtccagaaggccgtggatgacggcaacgcggcggtttccaaggcggaatcggtgcggaaattccgcattcttccctcccagttcacggaggagtcgggtcacatcacgccgtcgctgaagctgaagcgcaatgtggtggccaaggacttcgcggacgagatcgaggcgctgtaccgcggctagtccgggctgccgaccgcggctagcgggggtcctcggcgaggatccgggccatgttccgttccgcgagggcggtgatggtcacgaacgggttcacgccgagcgatccggggatcagggagctgtcgaccacgtacagcccctggtagcccttggcccgcccgtacaggtcggtggcgtccccgaggacgcagccgccgagcgggtggtaggtgaagttgtcggcgaaggccctgttgtcgccgaacaggtcgtaccggtacatcgtgaagttccgccggttgatgcggtcgaagaggttcttcgccgcgtcgaccgagggcgtgttctggtcccgccgccagttgagacgggccgagtcggtggcggcgtcgtaggtgaagtgcccgcgctcccggttcttggtgatggccaggtacatcgagatccagtgctcgatgcccatggggagcggggcgatctcggcgaagaccgggttcgaggcgttgtcccagtcgtcgatgcccatcgcgggcatggtggcctggttgcagccgaccgtgtcccacaggtggttggcccgggcggtcatgatgttgccgttgtggccccagccgagcccgaccttgtcgctgagcgcgggcagggtccccgtctcgcgggcccgcagcaggatctcggtggtcccgaggctcccggccccgaggaagagctgcttgcagccgagttcgcggacctgggtgacccgtccggtgacatcgctggtccggaccgtcagtacgtaccccccggccgggtcgggccgtaccccgaccacgcgctgcatggtctcgatggtgacgttgccggtgccgatggcggcggcgaggtaggtcttgtcgacgctcttcttgccgtggttgttgccgtagatgacctcgccggccagggccgagcgggtggcggtgccggccgcctcgcgctgcatgtacgcgaagtcgtagacgttggggacgaagacggtcttcaggccggtgttctgggcgtgcttgcgggagatccgggcgaagcggtaccactcggtggattcgaaccaggccgggtcgatgtcgttgacgccgagcatggcgcgggcgcgggggtagtaggtgccgtacatctcgtcggcgtcgacctggggcagcatctcggagaagtacgagcgcctgggtgtgggggccattccgccgttgacgagcgatccgccgccgacgccgcggccgacgtacacggacatgtcgccgtagttcacgcggtcgaggacgccggggtaggggctgatgtcgcggttgacgacgtcgagccagaggaactgggcgagcggggcctcggtgcggttgcggaaccacatcgagcgctggtcgggcgcggaggtggaggggaagaccttgccgtcggccgcgggggtgtcccagagccggcccatctccaggacgacggtacgcacccccgcctgcccgaggcgcagggcggcgacggcggatccgtaaccggagccgacgacgatggcgggggcgtaccgggctgcggcgggctccacggccgcggcggaggccgccccgatccgggtgaagccgagcgcggcggcggtcgagagggcaccgagtcccaatagttgacggcgcgtcaggttggatgtcatggccgcatcatgggcggaatccagccgtccgcccagacgcggtattgacagacatctgaggaacagtcagacatggctgcgcggcccgtcggcggcggcgaaatccagccccgccggcgttcgaggcgcgggggtccgggggcggagcccccggcagcggcgccgcaccggcaccggctacagcagctcgcgcaggcgttccgccaggaggtcccagcgccacttctcctcgacccactcacggccgcgctcgcccatccggcgtcgcagttccggatccttcagcagggtcacgatccggtccgccgcgtcctcgggggaaccgccccgcacgacccagcccgtctcgccgtccaggacggcgtccggcgcaccgcccgagtcgcccgcgatcaccggcaggcccgtggccgaggcctccaggtagacgatgccgagcccttccacgtccagcccgccccggcgggtccggcacggcatggcgaagacgtcaccggcgccgtagtgggccgcgagctccgaccacggcacggctccggtgaagacgacggagtccgagaccccggtggagacggccagctcgcgcaggtccgcctcgtagggcccgccccccacgatcagcagcaccgcgtccggcaccgccgccaggatccgcggcatcgcctcgatcagcgtgtcctgccccttgcgcggcaccagccgggagacgcagacgaccaccggccggtccgtcagccccagccgggccctgacctccgccccacccgatcccgggtggaaggtcttctcgtccacccccggcgggagttgcaccatccgggccgccgcccggtccgtcaccgccgacgcgatccgcgagcgcgtgtactcccccaggtacgtcagcgtgtcggtgccctcgccgatccggcgcagcaactgccgcgccgccggcagctgggcccagcccgcctcgtgcccgtgggtggtcgccacgatccgccgggcacccgcccgccgcagcgccgggcccatcagcccgagcggggccgccgccccgaaccagacggactcgcagccgtgttcgcgcagcaggcccaccgcccgccgcgtcacgcgcggggtcggcagcagcatcgtcgtccggtcgcggaccacctggaacggctgctccgcgtcgaaggccgcggtggcctcgcggccctccgcgctgtgcttccaggtggaggcgtagacgacgatccggtcgggatccagccgcagcgccatgttgtgcaggaaggcctggatgccgccggggcgcggcgggaagtcgttggtcacgatcagcgtcttgtgcatcgctgccaacgtaccggacgccctcagcggaattccgcccgcagggcctcctgccaggctttcaccaccgcgtccgggtccaccccgagggcctcgcgcaccgccaccggccacggctcgcgccccgccctcccgtacaggtccacgagcgccgcctcgccccagcgccccgcgaccgtccggcaggccagccaggcgccctcgtaggcccgggccagcgcctccgggtcgccgccgaaggcgaagtcctccgtccggggcagctcccccggtacctcgccccgccgtacggcccgggccagcgccggggcggcctgctccgggccggccgcggtgccgcggtaggccgcccagtccgcgaagccctcggaaagccacagcggggtggtggcggtcgtcgccgcccgggtggccacatgggtgacctcgtgggtcaggatgaccccgcggcccgccgggctgagctccgcccacccctgcgggttcacgacgacccggtccgcgggggccggggacgcgcccacccggcccgtggtgacggcccccatgccccggtactcggccgccgggcggcccagcagctccgccatccgctccagggagccggggaccagcaccaccgcccggcccgcccagggtcgcggccaggccgcactcgccgcgggcaccgcccggtcggcctccgccgcgatcgccgacagcgtcccgtcctcctgcccgacgcccagcaccagcgtgtgcgcgccgcggaccaccgccaccggcccctggtcccacagctgcggcagcgcgcccggcgccgcccggtccccggtgacgtgccaccgcccgccgtcccgggtcaggcgcacctcgcgcgccgacccggccgcggccgcgtcgtaggcgctcagccggtagcgcagctccgcgcgggcggtggcttcggcgccgtcccgccggaccgcggagacctcgtacgcccatccctccagcgggatcgcggcgagccgcgcgggcggcgtccgcgaccagtcggcgacggccgcccggatgtcacgctcggcgccgtcccgcggagcgggcgcgccgcatccggcgagcagcgcgcccagcaggagcggcagcacgcgtacgagggcgctgcggacggggaacatccgacgatcgtacgcacgggtgggtcaggggcgggtcacggaggagacgggcatcatcccgacggggtcgtagcggacccgggccccggggtacggggcgtgcaccacctggccgttgccgacgtacatgccgacgtggctggcgtccgagcggtacgtcaccaggtcgcccgggcgggcctgcgacagcggcacctgccggccggcgtgccgctgggcctgcgaggtgcgcggcagcgagaccccggcctgccggtaggaccagaccatcagcccggagcagtcgaagccggaggggccggtggaaccccacacgtacggccggccgacggcggcccgggccgccatcacggcggtctgggcgcggccggaggaggcaccggaggagggcagctcgggcaggccctcggagcggcctccggagcgcgaggagcgttcgtagtcggcccgctcctcggagggcatggcgttgagcagccggcgggccgccgcgagcttcgcggtgacggagcgcttgtgccgggccacgtcggagcgcagggcgtcgagttcggcgagtttgcgggaggcctcctggcgctcctggccgagttcgcgctgctcctcgcggagttcgtcgagctggcgggcctggcggcccgtcagccggtcgagggcggcggcctgctccaggtacgcgtcggggttctcggccagcatcagcccgactgcggggtcgatgccgccgccgcggtactgggccccggcgaaggtgccgaggacaccccgcatggtgttgacgcgctcctggccgcgggccaccgcgtcctgggcccggttgacctcgatgcggagccggtcggccttctcgcccgcctcgttgaagcgctcggtggcctgctcggcctcctcgaagaggcggtcgacctgggcgctgatgccggttctcgccccgccgggttcgtacgggaggccgggggccgcgctcgcgggtacgcccgtcatggcgaccgcggcggtggccgctgcggcggtgaggacggtgaccttcgtgttccggtcgaggccgccgagcccggtccggcgatgggacgccacgtgaaaccgctcccttccgctgtgcgtgcggggcccgggtccgccccccgtggacggccgtgtgccgggttccgcgctggcagacagtagcggcgcgaccacacaccggccaacgaccaccggtgggcgcacatgccgacgccccgcaggagacgcaggtcaccggcggggcgtgtggtcagagggaggccctggaattcgcccggatgggcggcgtacggcgcgtcccggagcggatcagccgacccggacgccgaactggaacggcatgttgtccatggactcgtacttgatgccgctgcgcgggttcgaggcgtgcagcgtcatgttgttgccggcgtagaggccgacgtggtgcaggtcgccgtagaagaagaccaggtcaccgggctggagctggctgcgtccgatgcgcgtgccgtcgttcacctgggtgaaggtggtgcggctgatgttgacgccggcctgcttgtaggcccactgcgtcagcccggagcagtcgtagaccgtggggccggtgccgccggactggtaggtgaagcccagcttcgtcttggcggcttcgagggcggctccggcccggccggaggccttgacgttgccgaggtcgacgcgctggccgtcggcgcggctggcgcgcgtgtcctcgtccttgatggccgcgcgctcctgcgcggtcagggtgttgaggagcgcctgggccgcggcgagcttctcggtggagaccttcttcttctcgccgagctccttgcgggtggcgtcgaggtcggcgagcttgcctgcggcctcctggcgctgctgcgcgagggtgcgctgcttctcctggatgcgctggactccctcgacctgcttggcgctcaggtgctccagagaggaggccttgtcgaggtagctgtcggggtcctccgagaggaggagcgcgagggagggatcgatgccgccgctgcggtactgggcgctggccatcgaaccgagcgtgctgcgcaggtcgttgagctcgccctggccgcgcgcgacctggtcctggagctggcctatctccttctccagcttgtcctggcgctctttggccccgttgaacttctcggtggcctgctccgcctcttcgtagagcgcgtcgacctggctcttgacctcgtccttgctcggcttcgccggcgcggcggaggcgctctgcgcggtgagggcgacggctgcggccgcgaccgaggtgagcacggtcacacgagcgcggttcggctgcttgggtcgacggtgggacgccacgaaggcgagctccttcttcctgggagccgccgaaggaacgcaactcggcagcaccttcgctgccaccccgaatgagtgatctaccgcacgaaggtttgagcagaccctagtgacccagctgtgatcagttcaaatcctgccgggaaaaaactcgccccccgaccaggttctttacctacagcgcacgctccgtgcaggtcacttgacggtgcgtcccccgcgagtcacaccaattcgggcatcacggcaaggagttacgaaacgcgcgaaagccgcttcagcaacaaagcggacgtcacgggtcgggcgcccgccttggccaccccgtcggcgacctcccggtccgtggagaccacgaccaccggccggccgggcggctccgcacgcaccagctggcggatcagctcgtccgccgtcaccccggccttggagaacagcacccgcaccccgcgcggcggcgccagcagcaccggggccgccagctccgcaccgtcgaagacgcacgtcatctccgcgcccgtctgcgcggccagcatcgacagcccgcccagcagccgcagccgctgcttctccagcggcatcgtcggatagcccgtcttggtcacgttgtagccgtcgaccaccagatgggcctgcggcagcgccaacaactggtccagcagagccggatcggtctccgacagggcccgcgccgcgatgtccttcggcgtcatccggcccggctccaccgcgtccaccgtgtccgcgggccgggtgctcaccggcggcagcgcgagctcgcggcgcagcccctgggccgcgtccagcacggtgtccagcagcagccgcagccgcatgtcctcgatgctgcgcccctcccgggtggcccggcgcgaggtctccagcgccgtctccacctccgcgagacgggacttgagccgtcggctctcgctctcggccgcggccacccgggcggccgcgtccgcgcgcatcccgtcgatctccgcattcaccttgcgcagggccgcgtcaccccgcttgacgtcgctgagggcgctgcgcagcttgcgctgaagcgattccgcttccttgcgcgccgcgtccagctcgacccggatctgctcgccgcccgtgcgctgcagttcccgtacgtgggccagctcctcgcgcagccgctccagctcgcgccgggtctcctcaccgacccgctcggcgtcggcgcgctgcgcctcctcgcccgcggcggccaccagcttgacccagccgttcgggcgcaggacgaaggcggcggccgccacgtccagcggatccgcggccgccggaggcgcaccggcctccagcgcggcggccaggtccgcctgcgcctcgcgcagcttctcggcgaccctgctccggaacacggcgtcggtctcgaccgccgcggccatggcattgcccgcgaacttggcgcgccgggtcggggtgaaccgggcatactggcgcagctgcgccgggaggtcagcgaccgtcagtccgccgaaggcgtccgagacgagcgcgacgacccggcgccgcacgccttccggcagcgggtggtcgagcgcctcggcggcgtcgccggccgcgtcggccgactcagcgccgcttgctggctccacaatccgtcacccctaccgtgatcttcctgtgggtgcgtctccgtcaggagtccgcgcccggcctgtccacgagctcgatctggtccaccgcgttgcaccaccggcagcggaccgactcgatggtctcattgaccacctcgcgctcctcgaccttgggctccccggcgaggtccaggtggacgtactccacgaccttcgacgaacgcgtgacgtcgaaacgcgtgaggttgccgcacagggtgcagcgccaccgggtggtgtcggtcggcaggggaaccgtcatcaggtcgctctctccttcgtaactgattcaattaaagccgcccgcgccgccgtatgcgtcgtcctgcggaccgcagctcgtaaccctacggcctgccaccgcttcaggtgggtcctgttgcgtcatgctctgtcacatgatcgtgaggtggcgggccgttcgcgaggccgcccggggaccggtggtcacccatgggctgatcgcgggctgcgccgtggtgttcgtactcggcccggcctcgggactcgatccctcctacggaacgggagaagagctgctgtccgccgggacggcctacttccggcgctggggcgtggtcccggacgagctcttcacaggcaccccccgcgcctggctgaccccgctcaccgcactgttcgtccacggcagctggctgcacctgctcgggaacatgctcttcctgtacgtcttcggcgcgatggcggaggaacggatgggccgcccggcgttcctcgccttctacctctgtaccggatacctggcgatggcggcgtacgcggcggccaacgcgggatccccgcagacgctggtcggggcctccggcgccatctcggccgtgctgggcgccttcctcttcctgctcccgcgggcgagggtgacgagcctgttcccgttcctcttcttcctgccgctgcggttcccggcgtggatcgtgctgctgttctggttcgccctccaatgggtggcggcgcagcgggccggcagcggtccgggagtcgcctatctggcccatctggtgggcttctcgctcggcttcctctacgcgtgggcccgctatcggggtacgactagagtgagtcgaccagcgacggccaccgagggagacagccagccgtgatcaccgcgatcgtgctcatcaagaccagcgtggaccggatccccgagatcgccgagtccatcgccgccctcgaaaacgtcagcgaggtctactccgtcacggggacgtacgacctcatcgcgctggtccgcgtggcccgccacgagaacctggcggacatcatccccggccgcatcagcaagatcccgggcgtcgaggcgacggacacgcacgtggcgttccgcacgtactcgcagcacgacctggaggcggcgttcgcgatcggcctcgacgcgtagcccctgcggggtgctcggcggtgctcgggtcgtcccggcccggggtgcgcctcaagcgccggcggggctgagtggtgcgggcctgtcggtccggggcggggcggggtgccgcgccggggtgtctcctcggctcgcgcctgcgggcatgtctcggctgtgcggggtggttgcgcgctcgtcctgcggggacaccccgccacgtccccccaccccgccgcggcatccgtcgaagccctgccgtggggcggggacacgcaggagggtccccgcaggacgagcgcgcaacccaggccgagccgcagaaccacggccgcaggcgcgagccgaggagaccctcgtgcggggccccgccccacaccacccagccccgccggcgcttgaggcgaccacccgggccggaacagcccgaacaccgccgagcggaccgcaggtcacacggccgggacgcagcggccctcctccgtgcggtactgccacttcgcgccgtccgcgacgagctccttcaccgcgcggacgaagcgctccacgtgctcgtcgggggtgcccgcgccgaagctgacgcggatcgcgttcagcgagcgctcccccggtgccgcctcgggggctccgcattcgccctgggcctgcggctcgctgcccagcagggtgcggaccagcgggtgggcgcagaacaggccgtcgcggacgccgatcccgtactcggccgacagcgcggcggcgaagtgggagctgttccagccgtccaccacgaaggagatgacaccgacccgcggggcgtcgtcgccgaagagggagaggatccggaccgccgggacctccgccaggccctcgcggaccttcgcgatgaggtggcgctcgcgggcgaccaggtgctcgaagccggcctcggtcagggccttgcaggccgaggcgatggagtagacgccgatgacgttcggggagccggcctcgtggcgggcggcggtggtgtgccactcgacgtccacgccgccgtcctcgcgccgggcgaccttgcgggaggcgccgccgcccgcgaggtagggctcggcctcctggagccagtcggcgcggcccgcgagcacgcccgagccgaagggtgcgtagagcttgtgcccggagaaggcgacccagtcgacgtccagctcctgcacggagacggggtggtggggggccagttgggcggcgtccagcacgatgcgcgcgccgtgggcgtgcgcggcggcggcgagttcgcggaccggccacagctcgccggtgacgttggaggcgccggtgacgcagaccagtgccggaccgtacgggtcgcggtcggcgagcgcccgctccagggtggcgacggcttcggccggggtgcgcggtgcgttgaggtaggtgacccgtgcgtcggcccacggcagcagggaggcgtggtgctcggtctcgaagacgaacacctggcagtcggcggggagtacggcggcgagcaggttcagcgagtcggtcgtggagcgggtgaagacgacctggtcggtggggcggcagtcgaggaactcggcgacggtgacccggctctgctcgaagaggtcggtggagagctgcgagaggtatccggcaccgcggtggacgctgccgtagtacggggcgtacgcggccacgtcgtcccagacgcgctgcagggcgggggcgctggccgcgtagtcgagggccgcgtaggtgacctcgccgccggtgacgagggggacggtgacgtcgcggccgaggaccgcgagcggctcggcacaggcggggtcgacggcggcggtggcggtggcgacggcggcgttcagggatgcggacatggcggtatctcccggcaggcagggctgaatggcttcggtgtgcccgtacgcgggtacggcgctgcggccgtccggggtacggggaagtcctcggtccgcgctgggcgggggtacacggaagtgaccctgtccgaggggtgaagtgggggcggagtcgccctatcgcattcgcttgctcacggaaaaagctcctcgagaagaccaggacccctggtgtcgagggatccgcgcttgccgtaggccttgctgcctacgacctggtcatcacccggggcaccccgccacggaaggagggttgccggacagcaagccggggcctaaacgctgtcactcgtgacctggtcagcatcctgccacaagatcggccgaacgcaagaccccggtccgcatgccggaccggggtcatcgctttcgcgccgtacggcctaggcgttgctggccgccacccagcgctccagggcggcccgggccgcgcccgagtcgatcgactccgccgcacgggcgatgccggccgtgatctgctcctccagggtgcccggggcggggtcgagggccaccagggccgccgccgagttcagcaggacggcgtcacggaccgggccggtctcgcccgccaggaggcggcgggccacgtccgcgttgtacgaggggtccccgccggccagcgcggagacgtcgaccagggagatgcccacgtcacgggggtcgaagcgctgctcggtgaccttgccgtcgcggacccaccagatctgcgaggccgacgtcgtggtcagttcgtccaggccgtcgtcgccgcggaagaccagtgcggaggagccccgcgcggcgagcacgcccgccacgatcggggccatccgggggtcggccacgccggtcgcctgggcgcgtacccgggccgggttggtcagcgggcccagcgcgttgaagaaggtgcggatgcccagttccctgcgggcggccgcgacgtggcgcagggccgggtggaacttcaccgcgaagcagaaggtgatgccggcctcctcggcgacctccacgacccgcggcaggctgaggtcgaggttgacgccgagcttctccaggacgtccgaggagccgctcgcggaggacgcggcgcggtttccgtgcttgacgaccttggcgccggtcccggccacgacgaccgcggacatggtggagatgttcaccgttttggccccgtcgccgccggtgccgacgatgtccaccgtgcggcccggcacctcgatcaggttggcgtgcgcgtacatcgcccgtacgagcccgttgatctcctcgaccgtctcccccttggcccgcagcgcgaccgtgaagccggcgatctgggcgtcggtggcctccccgcgcatgatgcggtccatggcccaggcggtgtcctccgcgcgcaggtcccggccggtcagcagagcgtcgagaacgcccggccagccacgggccgccacgctgtcgccgcctgccggggtcgcaacgttcatggtccgctcctgctgtcggtggaggattccacgtctgatcggtcagggatcagcctatccagccccggttacggcaaagagccccgtccagacactggacggggctctcgccgtggcgacaccaggactgaccgaaatcagcccctcatgcgttcatgcggggatcagtggtggccgtggccggactggatctccttgtattcctccaccgtgggcttcggaatctggttgttctcgccgtacatgccctggctgagcttcgcgcgcagcttctcggtggccttcaccttgcgctcgacaccgttctcgtcgaccgtcgggccgatctcgaccggcttgtactgctcgtgcgcggtgagcttgtgcagctggcccgccgggagcggctcgtggacctcgacgaactcgccgtgcggcagacgcttgatgatgccggtctcgcgaccgtgcagcaccttgtcgtggtcacggcgctggaggccgaggcagatccgcttggcgacgatgaacgccagcaccgggacgacgaagaagccgatccggacgaaccacgtgatcgagttgatcgacaggtggaagtactgggcgaacatgtcgttgccgccgccgatgaggagcacgatgtactccgcgatccaggcgacaccgaaggccgtgcgggtcgggacgttgcgcgggcggtccaggatgtggtgctcgcgcttgtccccggtgacccaggactcgatgaacggccagacggcgatcgcgccgagcaccagcgggaagagcagcagcgggatgaacacacccaggacgagggtgtggccccacaggttgatctcccagccgggcatggcccggatcaggccttccggcatacccatgtaccagtcgggctgcgcaccggtggacacgtggtccgggcggtacgggccgagcgcccagatcgggttgatcgtcgcgacggccgcgacggccgcgatgacaccgaagaccaggaagaagaagcctccggccttggccatgtagaccggcagcagcggcatgccgacgacgttgttgttcgtcttgccgggacccgcgaactgggtgtgcttgtggtagaagaccaggatcaggtgggccacgagcaggcccatcatgatgccgggcagcagcaggatgtgcaccgagtagaaccgcgcgacgaagtcgccgcccgggaactccccgccgaacaggaacatcgacaggtacgtgccgacgaccgggacggacaggatggcgccctgcatgaagcggacaccggtacccgagagcaggtcgtccggcagcgagtaaccggtgaagccggtgaacatgccgaggaccagcagcaggaagccgaagatccagttgacctcacgcggcttgcggaacgcgccggtgaagaagacgcgcatcatgtgcacgaccatggccgcgacgaagatcagcgccgcccagtggtggatctgacggatcagcaggccaccgcggacgtcgaagctgatgtcgagcgtcgaggcgaaggcctcggacatcatgacgccctgcatcggcacgtacgagccgtggtacacgacctcgttcatgctcgggtggaagaacagcgtcaggtacacacccgtgaggatgatgatgatgaagctgtagaggcagatctcacccagcatgaaggaccagtggtccgggaagatcttgcgcatgttggccttggccaggccgtagatgcccaggcggccgtccgcccagtcggctacgcgctcgccggccggcgctttgcgttcgttgttgctgctggtgctcatccgcgctcccagaatgcaggaccgacgggctcttcgaagtcgccgagcgcttcgaggaagccttcgtcattcacgccgatccgcagctgcggaagcgcgtgaccggccgggccgaagatgacacgggcgccgtcggagaggtcgaaggtggactggtggcacgggcagagcacgtggtgcgtctgctgctcgtacaggctgatcgggcagccgacgtgggtgcagatcttggagtaggccacgatcccgtcgtgggaccactccagttccttcttgtccttgatgtcgtccggctggatacggacgatcatcagggcggccttggcgatctggacctggaagtcgtgctgctcctcctccaggccttcgggcctggcgaaggtcagcgacccgacgaggacgtcctcgggacgcagcggctcgttcgtgttgtcgttgatgagcagcttgcccttggcccacacggtcttgcgcagcttgtcctcgggcagcgggcccaggtcgcgcatgatcatgacggcggagagcggcagcatggccagcgctccgagcatcgtgttgcggatcaggggccggcggccgatgccggactcgttcgcgccgtcggcgaagtcctgcaggacctgcgccttgacctccggcggagcggcgatctcgtggcgctcggcggcgacctccacgtcggacatcagggtgcgggcccagtggaccgcgcccgcgccgatgcagaagagagccgtgcccagggtcatgcccagggagaagttgagcgcgctgaccttcccgatggggaagatgtagacgatcttgtcgaccgggaagatcacgtaggacgcgatgaagccgatcgtcgccagcatcgacagcgtgaagagcatcgcgacggtgcgctcggagcgcttcgccgcccgctcgtcgatgtcctggatgcggggcttgtggaccggcaggcccgggtcggcgaacgggtcgtccgcgacgactacgccaccgtggtgggcgtcgccctgctcgctcggcaggtgcttctcttcgggaatctcttggttactcatgacttcttggccttagcggtgtgggccgcgacccagacggcgacagcgatcagcgcaccgagggcgaagatccagccgaacagaccctcggagacggggccgaggccaccgagcttcaggcctccggggctggtggacttctcgccgttcacgttctcgaggtacgcgatgatgtccttcttctgcttctccggcatggtgctgtcggggaaggagggcatgttctgcgggccggtcagcatggcctcgtagatgtgcttcggcgagacaccctcaaggttgggggcgtacttgccgttcgtcagtgcgccgccctcgccggtgaagttgtggcactgcgcgcagttgttgcggaacagctcaccaccgttggcgatgtcggcgcccgccgggtcgtactgcttctcggtcggcgtgatcggaccggcgccgagggacgcgatgtacgcggccagctggtcgatctgcgcctgttcgtagatgacgggcttcttcggcacctgggcgccgggctgctgggcgggcatgcggcccgtgctcacctggaagtcgacggccgcggagccgacgccgaccaggctcgggccgtcagaggaaccctgaccgccggttccgtggcagcttgcgcaacccacggcgtagagcttcttgccctcctcgatggcgagggactgggcggtttcatcggcctgcgccttgcccgcgggggcgaaggcggcgtacagccccccagtggccgccagcgcgaggagtagaacgacgaccgccgccagcggatggcgtcgtcgtgcggagagctttttcacggattaccccggtgtcaggatcttctgcgtcggtgtgtctggatggagtgccgggtcttgcccggtgacgtgttcgctacttgatcaggtagatcgtcgcgaagaggccgatccagacgacgtcgacgaagtgccagtagtaggacacgacgatggccgacgtggcctgttcgtgggtgaacctcttggccgcgtacgtccggccgaggaccagcaggaaggcgatgagaccgcccgtcacgtgcagaccgtggaagccggtggtcaggtagaacaccgagccgtaggggtctgacgagagggacaggccctcatgcttgaccagctcggtgtactcgaacacctggccgccaatgaagatcgcacccatgacgaacgtgatgatgaaccacgtcctgagcttcttcacgtcaccgcgctcggcggcgaatacgccgagctggcaggtgagcgaggaaagcaccaggatcgtcgtgttcgtcgccgagaagggcagattcagggcctcggcctgttctgtccagaactcgggacccatcacggatcgcagggtgaagtacatcgcgaagagggccgcgaagaacatcagctcggaactcaaccagatgatggttccgacgctgacgaggttcggccggttgaccgtcgggtgcgcgtgcccggtatctactgtcgttgctgtcgccacgaccgacattatgtcggtcgcttatcccgccctcaccccggggggtgccgttcggagtgtcaggggcgtgtgcaaggcccgaacggcccatcagatgacccccgcccgcggtcacctgcgacatgttcgaaccgatgttgacggcgcaccgggaggagtagcatcccgcgcaacatcaacgtgattcacggccacgtggaggaacgaaatgcgggcgactgcgcgggttctggtctacagcgacgacgcgggcacccgggagcaggtgcggctggcggcaggacgcaggcccgccgcggacctgccgccggtggagttcctggagtgcgcgacgctgccggcggtcctgacggagctggacgcgggcggtgtcgacgtgtgcgtgctggacggcgaggcggttccggccgggggcatgggcgtgtgccggcagatcaaggacgagatcttccggtgtccgccggtgctgctgctgatggggcgcccccaggacgcctggctggccacgtggagccgcgcggacgccgccgtgacccttccggtggacccggtgccgttcgcggacaccctggcgggcctcctgaggacccgtctgtccctggacgcctgatacgtcccgcgggcccgtacgcgccccgcagggggccttacgggtgaagggagccgggatcactccccccggggcgtccggggggaggggccggcggcctagacggtggggcgcaggcgggcctggtcgaccggactgcggccttcctgggtgcccttgagcagggcgctgccctggcgccagtccttccagtccatgttccagtcgccgaagccgttgccgaaggtgtccatgtcgtcgccgatgctgttgatcaccttgacgatgtcaccctcggtgatgttctcgtagaaccaggcggcgttgccggtgctcatgcccgtgcagccgtggctgacgttctcgtagccctgggagccgacggaccacggcgcggcgtggacgtattcaccactccaggtgacgcgggtggcgtagtagacgggcaggttgtagtactcgctgccgccgatgccgacggtgtcgccgcgcatctgtacgaagtactgcttgcccagcaccaccttgatgccgttgcgggtggagaagccgggctttccggtggtcaccggaatggtgttgatcacttctccgttgcgcttgaacgtgaggtagtgcgaggaggcgtcggtggtgacctcgacccggtccccgatctccagcttcagcggcttggcgacggctccgtggagctcgtcggtgatcctgacgccctccaggttgctccgtacggagacctcggagttggcgggccagtactccttggggcggtagtggaggttcttgtcgtccacccagtgccaggcgccctcgacgccgggcggggtgtcgacgaccaggccccgttccacgatggcgcgggcggccttgtccttgacgggctcgctgagttcggcggtgaggggctgcccgacgccgtacttgccctcgtccgggccgaactcgatcttcaggatccccttggacggggtggtgtcgaaggcgagcgtgcgctgccccggggcgccccgctcgtcctcggtgctcacggtgaccgtgtagcggacaccggaggccatcggggtcgtgctgtgccagcggtcccccttggcgctcagttcgcccgccaggcggcggccgtgggtgtccacggccagcacgtcggtgatccggccaccgccgctcttggcggtgatttcgaggggccggtcggggtccacggggcggctgccggcgctctggttgaaggcgacctgatcgcccgcgtcgtacgggcgggctgacagcgggttcttgtcgccggacccgcatgcggtggcgccggccccgagggacgcgaccagcagggagcagctgagtaccgtccaaagacgcggtgagtgcttcatggagccaacgctatgaagatatgacaattacggcgcgcgggatgactgcaaacgaggggcccgggctcctcccgaaggaggggcccgggccccaggtgacgcgcggcgcggccgcgcgggtgctgctactggttctggttctcaccgcggtagtactcgtacacccagccccacaggccgatcatgatgatcggggccgagaagtacatgagccaccagccgaagatgacgcccatgaaggcgagcgcaccgccgatgcccagcgagagcggctgccagctgtgcggggagaagaaccccagctcgcccgcctcgtcggcgacgtcggcctccaggttgtcctgggccatctcgtccacgcgcttggccgtgaaggccaggtagtagccgatcatgacgctcaggccgaaggccaggaagagcgcggtggtaccgacgggctccttcgaccacacgccgtacacgacggccatgatcaggatgaagaaggagagccagaggaacatcttgccctggatcttcacttgccggcctccttgccaccggtgacggccttggcggcgacgctgtggtcctcaaggtggtcgagggccgcgatctcagggtggtgcagatcgaacgccggcgactcggaacggatccgcggcagggtgaggaagttgtgccgcggcggcgggcaggaggtcgcccactccagcgaacggccgtaaccccacgggtcgtcgacctcgatcttcttgccgtacttggccgtcttccagacgttgtacatgaacggcagcatcgacaggccgagcacgaacgagctgatcgtcgagatcgtgttcagcgcggtgaaaccgtcggcggcgaggtagtccgcgtaacgacgcggcatgccctcggcaccgagccagtgctgcaccaggaaggtgccgtggaagccgatgaacagcgtccagaacgtcatcttgccgaggcgctcgtccagcatcttgcccgtgaacttcggccaccagaagtggaagccggcgaacatcgcgaacaccacggtgccgaagacgacgtagtggaagtgcgcgacgacgaagtacgagtcggagacgtggaagtccatcgggggcgaggccaggatgacgccggtcagaccaccgaaggtgaaggtgaccaggaagccgatcgtccagagcatcggggtctcgaaggacagcgagcccttccacatggtgccgatccagttgaagaacttcacaccggtcggtaccgcgatcaggaaggtcatgaaggagaagaacggcagcagcacaccgccggtgacgtacatgtggtgggcccacacggtcaccgagaggccggcgatcgcgatcgtcgcggcgatcaggccgatgtaaccgaacatcggcttacggctgaagaccgggatgatctcggagacgattccgaagaacggcagcgcgatgatgtacacctctggatgcccgaagaaccagaagaggtgttgccatagcaaggcaccgccgttcgcggcatcgaacacatgcgcaccgaacttgcggtcggcctccagcgcgaagagtgcggcggccagcaccgggaaggcgagcaggaccaggacaccggtcagcagcacgttccaggtgaagatcggcatgcggaacatcgtcatgccgggagcgcgcatgcagatgatcgtggtgatgaagttgaccgagccgaggatcgtgccgaagccggagaaggccagacccatgatccacatgtcggcgccgatgcccggcgaacggaccgcgtccgacagcggggagtaggcgaaccagccgaagtcggcggcgccgttcggcgtgacgaagccggccaccgcgatggtcgagccgaagaggtacagccagtacgcgaacatgttcagccgcgggaacgccacgtcgggcgcgccgatctgcagcggcatgatccagttcgcgaagcccgcgaagagcggggtggcgaacatcagcagcatgatcgtgccatgcatggtgaacgcctggttgaactgctcgttcgacatgatctgcgtgcccggacgggccagctcggcgcgcatgaagagcgccagcaggccgccgatgatgaagaacacgaacgacgtgaccaggtacatcgtgccgatggtcttgtggtcggtcgtggtcatccacttcacgaccacattgcccggctgcttgcgccgtaccggcagctcgttctcatacgagtcggcggcggcaccctgggattcgttgaggatgctcacagtttgttcacttccgcattccgggccgggtcggtctgctggataccggccgggaggtagccggtctgacccttctccgccagacccttcaggtacgcccggtactcctcaggggagaccaccttgacgttgaagagcatccgggagtggtcgacgccgcagagctcggcgcacttgcccatgaaggtgccgtattcggacggggtgacctcgaagacgttggtgtggcccgggatgacgtcctgcttgaacaggaacgggaccacccagaaggagtggatcacgtcgttcgacgacaggatgaaacggaccttctcgcccttggggagaaccagggtcggacccgggttgcccgtctgcgggttccggtcgccggggacacccttctggtagacgccctcggcgcccgccgggaagtccttggtgaagcggtccggaatggaggcgagctccttggggacctcgttcttcgccggggtcgccccgtcaccgtcgacgttctcgacgtagttgaagccccagctccactggaagccgatcacgttgatcgtgtgcggcggcttcggggtgagggccaggagcttcgactcgtcacgagcggtgaagtagaagagcaccgagacgatgatgagcgggaccacggtgtacagcgcctcgatgggcatgttgtaccgggtctgcgcgggaacctcgatcttcgtccggctgcgccggtggaagatgacgctccagatgatcaggccccacacgaggatgcccgtgaccagcgcggccgcccaggatccctgccacagggagaggatgcgcggcgcctcctcggttaccggagtcggcattccgaggcgggggaagtctttccatgtatacgagcaaccagtggcggtcgccaggaccacgcccgcagtcagcgcctgcagcagcttccgccgcatcgggcgccgcggcgagcggtcggagccgtagggactcacgtagcgccttcccgagagtctcggcccgcgcggccggccgcggccgtgttcgggtcggtcgccggccctgacgcaggcaggggtttggatgtttatgcggaccaaaccctactggacgctatttggggtcgcgcggggagggtgcccaacgcgccgctactgcccccgaagggatggatccgccgtccgggggacggtgcgaatggccctgaatggcgggctccggggcacatctgacgccccctgacctcgaacgctgcgggtccggggttagcgtgaccggatgccgtacttcgacagcgcgtccgccgctcccctgcaccccgtggcccgccaggcgttgcaggcctccctggacgagggctgggccgatcctgcccggctgtaccgggagggaaggcgcgcccggctgttgctcgacgcggcgcgggaggccgccgcggaggccgtgggatgccgggccgacgagctcgtgttcactccttcggggacgcacgcggttcacacgggagtggcgggggtcctcgcgggccgccggcgcgtcggaagtcatctggtcgtatcggcggtcgaacacagttctgtattgcacgcggccgaagtgcacgaggcgcgcggcgggacggtgaccgaggttccggtggaccggtggggcgcggtgtcgcccgccgcctacgcggacgcgctggtccccgagagcgccctcgcctgcctccagtccgccaaccacgaggtgggcacggtccagccggtggcggaggtcgccgagatctgcggggcggccggggtgcccctgctcgtggacgcggcccagtcgctgggctggggaccggtggagggagcctggtccgtcctggccgcgagtgcacacaaatggggcgggccgcccggagtcggcctgctggcggtccgcaagggggtgcgcttctcccctcaaggcccggcggacgagcgggagtcggggcgctcccccggtttcacgaacctgccggcgatcgtggccgcggcggcctccctgcgggccgtacgggccgaggcggacgcggaggcggcgcgactgcggatcctggtggaccgcatccggcgacgggtggtgcggctggtcccggacgtggaggtggtgggcgatccggagcggcgcctgccgcacctggtcaccttctcctgtctgtacgtcgacggggagacgctgctgcacgagctggaccgggccggcttctcggtctcctcgggctcctcgtgcacgagctccacgctgacccccagtcacgtgctgcgggcgatgggcgtgctgtcggaggggaacgtacgggtgtccctgccgccggggaccccggcggaggaggtcaacgcgttcctggaggtgctgccgcgcgcggtggcggacgtacgggaacggctcggcgtgtcggagcccccgccggtggctccggtggcggactccctggagctcgacgcgctggggctgcggtgcccgcagccggtgatcgagctggcccgggccatcgtgacggtccccgtgggcggcacggtcacggtcgtctccgacgacgaggtggcccggctggacatcccggcgtggtgcgcgatgcggggccacacgtatgtgggcgagaccccccgcgaggtcggctcggcgtacacggtccgccgagccgtctgacggcacgtttcagcctcgccggcgtttgaggcgcggggtctggggcggagccccaggaaacccggctccgccgggcaccgggctccgcccggacccgctcctcaaacgccggaggggctggatgcggcccgggtcaggagaggtgggcgcggacctccgccgcggcttcgtcgccgtaggccttggtgaagcgctccatgaagtgggcccgggccagggtgtactcctgcgtgcccagggtctcgatgaccagcgtcgcgagcatgcagcccagctgcgccgcgcgctccagcccgaccccccagcccagaccggtcaggaacccggcgcggaacgcgtcgccgacacccgtcgggtcgaccttcgcggtctcctcggggcagccgaccacgatcggggcctcgccgacgcgctcgatcctgacgccgttcgagcccagcgtggtcacacgggtgccgaccttcgacaggatctcctcgtcggtccagccggacttcgactcgatgaggcccttctcgtactcgttcgagaagagaaaggtcgcgccctccatcagggtgcggatgttgtcgccgtccatccgggcgatctgctgcgagaagtcggcggcgaaggggatcccgcgcgtgcggcactcctccgtgtggcgcagcatcgcctcggggtcgtccgcgccgatcaggaccaggtcgagcccgcccacccggtcggcgacggccttcagctcgatctgccgggcctcgctcatcgcgcccgtgtagaaggagccgatctggttgtggtcggagtccgtggtgcacacgaagcgcgcggtgtgcaggacctcggagatccggacggactcggtgtcgacgccgtgccggtccagccaggcgcggtactcgtcgaagtcggagccggcggctccgacgaggatcgggcggctgccgagctgccccataccgaagcagatgttcgggccgaccccgccccgacggacgtcgaggttgtcgacgaggaaggagagggagaccgtgtgcagctggtccgcgaccagctggtcggcgaaacggccggggaaggtcatgaggtggtcggtggcgatggagccggtgactgcgatgcgcacggcgtggacgctcctgctgaggacggcgagggacagtcaaaactacccggtaagcgcccctgggctgtacccccgaaactaccccttagtaggtctttcttcgcgtgaccttggatgcctacggtgccttcatgacctacaccgacggtttcggctactcggagtacaccgccgacaagcgcggagcggaagccccacggcagcccggtttcgcccgcctgctgggtgactgtgcccggatggccccgcactgggcggtcccggcgggcccccggccgctgcgcgtggccccctcgcagatccacgggatcagcgttccgcccgcgtcggcgcggctgatcgcctccacgtccgtgtacggggaccagtaggagggaaccggtttcgctcccgctccgtcacacccgcatcaggtacgacgggaccggtgaaggagcgatgcggtgaccagcgaacgacccgacgacacatcacgcggcacacggcggcggcccgcctgggccgtcggctcgatcgcggccgccgtcctgctggcgggcggcggcggcgcgtactgggcctcgacggcctacggcgacggtgcttcgggccaccgtgcgggtgagcgcgcggcctccgcgccccgcgacgcgggagacccctcgggtccgggcatcgcgcccggggagcccgacccgtccggcggcggggtggtctaccgggccgatgtgaagcttccggaggccccggccgccaccgcgcccacctacgcgctctccggcgaggtcacctcggcggaggtggcccgcctggcggcggccctgggtctgcccggcgagccgcgcctgagcggggacgtctggctggccggggaggccgccgacggctccgggccgcggctcacggtggcgcgcacggcgccgggcacgtggaacttcgcccgcttccaggcgccgggcaacggcagcggcagcggtgccggtgacgactgtgtgcgcggcaaggacacctgcggcccggccaccctcccgaaggacgcgggcggcgcgggtgcgggcggcgggacccccgcgggcaagccggtgtcggaggaggccgccaaggccgcggcggctcccgtgctggccgcggcgggcctggagggagcctcgtcggacgcccggctcacccagggttcggtacgggtggtggccgccgacccggtggtcggcgggctgcccacgcagggctggtccacgaaggtcagcgtcggctccgacggcgcggtggtggcgggcaacggggagctgaaggccccggtacgggccgccgagcagccggtggtcggcgccgtggaggcactggcccggctgaatgcgaagtcgggcggccgtgagggcaaccccgagcccagcggatgcgcgagtgcggtcccgctgacggcggacaccccggacacactgccgtgcaacccggagccgcggccgatgaagcccccgcggacggagaccgtgaagggcgctgtgctcggcctggtgcccggcgcggtgaacggggcgcagggcctggttccggcgtggctcttcgaggtggcgggccagggcggcgggcccggtcacacggtggcgcagccggcggcggcccaggagagcacgcccggcccgaaggacggccggaccgtgcccgggttctcgtacgcggaggccgaccggaagctgacggtgaacttctggggcagtgtgtgcagcacctacgccgtggaggcgcgggagcaggcggagtcggtcctggtgaagatcacggacaccccgaacaagccgggtcaggcctgcatcatgctggcgcaggagatgtccttgacggtgacgctgcagcagcctctgggcgaccggaaggtgctggacgcgacctcgggcaagccgctcccccggcagtgaccgcgggggccgcgtgggccgcgggagtcgcggcagtcgcggcccacgggcgggaccaggcatgacacgagggcccgcccccggtcggattccgaccgggggcgggccctcgtcgcgtgcgcgtccaggcctagctgaacgagtcgccgcaggcgcaggagcccgtggcgttggggttgtcgatcgtgaagccctgcttctcgatggtgtcgacgaagtcgatggaggcaccgtggaggtacggggagctcatccggtccgtgacgaccttcacaccgtcgaagtccttcacgacgtcgccgtcgagggagcgctcgtcgaagaagagctggtagcgcaggccggagcagccaccgggctggacggcgacgcgcagcgccaggtcgtcacggccttcctgctccagcagggtcctgaccttctcggcggcggcgtcggacaggaggatgccgtcgctcacagtggtcttgtcgtcctgtacggacatctgcattcactcccgaagtgggcggctccccgcctgaggcggggaaacgtcggactcttgccgtcggtggcaacgagcgggaccgcggattcattccgggacccgacgcttgtttcagatattccatgctcgcacaccgcgcgcgggggtgggcccggtgaatcgtgggctgatgcgtcacattgacactatcggcatcgtcaaactgacgtgaagcggttatgatagatagcgtcaagtagacgagaagtcgtagcgatgatccagaagtcccttgtcgcagaacagaaagggtgcgtgtcgtgaccaccgcccagcccttggacgtccagccgacgccccttgccctgctgctgctcggccgtgaggccgaccccaagagcgagcgcggggtggagtgccccggcgacctgccctccccgtcggacccgaacctcgtggagcgtgcccgcgcggccaaggagaagctcggtgacaaggtcttcatcctgggccaccactaccagcgtgacgaggtcatcgagttcgccgacgtcaccggcgactccttcaagctggccaaggacgcggccgccaagccggaggccgagtacatcgtcttctgcggcgtgcacttcatggccgagtccgcggacatcctgacctcggacgaccagaaggtggtcctgccggacctggcggccggctgctcgatggccgacatggccaccgccgagcaggtcgcggagtgctgggacgtgctgaccgaggccggcgtcgccgatgtcacggtgcccgtctcgtacatgaactcctccgccgacatcaaggccttcaccggcaagcacggcggcacgatctgcacctcgtccaacgcgaagaaggccctggagtgggccttcgagcagggcgagaagatcctcttcctcccggaccagcacctgggccgcaacaccgccgtccgcgacatgggcatgtccctggacgactgcgtgctctacaacccgcacaagccgaacggcggcctgaccgccgagcagctgcggaacgccaagatgatcctgtggcgcgggcactgctcggtgcacgggcggttctcggtcgactcggtcaacgacgtccgcgcccgcatccccggcgtgaacgtcctggtccaccccgagtgcaagcacgaggtcgtcgcggccgcggactacgtcggctcgacggagtacatcatcaaggcgctggaggcggccccggccggctccaagtgggccatcggcaccgagctgaacctggtccgccgcctggcgaaccgattcgccgccgaggacaaggaagtcgtcttcctcgacaagacggtctgcttctgctcgacgatgaaccgcatcgacctcccgcacctggtgtggaccctggagtccctggccgagggcaacctcgtcaaccagatccaggtcgacaaggagacggagagcttcgcgaagctcgccctggagcggatgctggcgctcccgtagcccgtccggacccgatcgccgagaaggggcaccccaccggggtgccccttctcgttgtggccgcccgtccggcacgcgccgaggggcgccccggaaaccgggacgcccctcgggtctcaccgcgggcccgtcagacgcgggccggagcgtcgtccgaggcctcggacggggtcggcaccgacgtccgtcgggcctcgcgcttcgccgtgcgcttggcgcggcggcgctccttgcggagctcgaccatcgtgtagagggtcggcaccagcagcagcgtcagcagggtggagctgaccaggccgccgatcaccacgaccgcgagcggctgcgagatgaagccgccctcgccggtgacgcccagcgccatcggcagcagcgcgaagatcgtcgccagggccgtcatcaggatcgggcgcagtcggtgccggccgccctcgatgaccgcttcgacgacgcccaggccctgggcgcggtactggttgaccaggtcgatcagcacgatcgcgttggtcaccacgatgccgatgagcatcagcatgccgatcatcgccgggacgcccatcggggtgccggtggcgatgagcaggccgagcgcgccggtcgccgcgaacgggatggagaccagcaggatcagcggctggaccagcgaccggaaggtcgcgaccagcagcatgaacacgatcgcgatggccgcgagcatggccaggcccagcgacccgaaggcctcgtcctggtcctcggagacgccgccgatggaggcggtgacgccgtccggcaggtgcagggccttgagcttggtctgcagttcggcgctgaccgcgccggtgttgtcgccgagcggccgtgcggtgacggtggcggcgcgggcgccgtcgatccgggtcatcgcgaccgggccggggacctccttgacctcggcgatgtcgccgagcttggcggggccgaccgggagcgcccgcagttcggccagggtggtggccggctgcgcggaccggatgacgatgtcccgctcggtgtcgtcgagtacggccttgcccgccgggttgccccggacggcctgcgagacgatcgcgccgagcgcggcctggttcaggccggcctcggccgccttgggggtggcggtcacggagatgcggggcacggactgggacaggtcgctctgcacgtcggcgacgttcttgagcttcgcgacctcggcgcggacctgctcggcgccgtcggccagggccttggcgtcaccggccttgacgaccacgctgaggttctggctgccgaagccgtcgcccgcgacgatgcgggtctcgccgatgccgtcgagggcggccagcttgccctcgatgctcttcttgacggcgtccgccttgccggagtccttcaggctgacctggtacgaggcctggttggagcccgtaccgccgccgaaggcggcgaggaagccggaggagccgacggtgacctggtagctcttgatgccgtcgaccgaggccagcaccttctcgatcttgcggctcgcctcgtcggaagcggccagcgaggtgcccggcgcgagttcctgcttgaccgtcaggacttcctgctcgccctggtcgaagaagttggtcttcagcatcggggtcatcccgaaggtgccgaagaggacgaccaccgcgatggccacactggtcaggcggcgccgggtggcgaagcccaggacgcggacgtagagcagctggaggcggctgcgcgcctccttctcctccgcctcgcggcgggccttcgccgcgctctcggcgttgccgggctcgacgcccttgggcgcgcccaggaaccagtacgagagcaccggtacgaccgtcagcgagacgagcagcgaggccagcagggccgcggtgacggtgagcgagaaggagccgaagagctcgccgatcatgccgtcggtgaggccgatcggcaggaagacggcgacggtggtgagggtggaggaggtgaccgcgccggcgacctccttgaccgcggtgatgatcgcggcctcgcgctcctcgccgtagccgaggtggcgcttgatgttctccaggaccacgatcgagtcgtcgaccacgcggccgatggcgatggtgagcgcgcccagggtcagcatgttgagcgacaggtcgcgggtccacagcacgatgagcgcgaggaccacggacagcgggatggagaccgccgtgaccagcgtcgagcgcagcgaggccaggaagaccaggatcacgatcaccgcgaagagcaggccgagcatgccctcggtggtgaggctggagatggacttggcgacggccgggccctggtcgctgacgacggtcagctcggcgccggcgccgagcgcggtgcgcagctcgggcagcttgtccttgacggcgtcggagatggcgacggcgctgccgtccttgtccatggtgaggacgagggcgaggctgggcttgccgttggtacgggtgatggagacggccttggccggctcctgcttcacgctggcgacgtcgccgaggcggacggccgacttgcccgtgccggagctcaggcgcaggtcctccagctgggcgagggaggtgtagccggagccgacgcgcacggtgcggttcttgcccgcctcgtcgaaggagccggcggggacggccgcgccgcccgcctggaggccctcggcgagcttgacgccgtcgaggccggcggccgcgagcttggcgttgtcgggggtgacggtgacctggaggtcctggacgccgtcgacggtgacctggccgacgccctcgatgtccgagaggacggggacgacggaacgttccagctggtcggcgagcgcctgctggtccttgccggaggtgacggccaggatgacggtcgggatgtcgtcggtggaaccggccacgacctgcgggtccacctcggcgggcagccggacgcgggcccggttgacggcctgctggacgtcggcgacgagctgcttggtgccgccgtcgccgtagtcgaaggtggccatgatgagggcgttgccctcgctggcggtggaggtgatgccggtgaggccgtcgacgcccttgagtgtggcctcgatcggttcgacgacctgcttctcgaccacgtcgggcgaggcgccctggtacggcgcgagcacggacaccatcggcaattcgatggagggcagcaactgctgcttgagctgcgggatggctatggcgccgaagagcagcgccacgatcgacacgaggccgaccagggccctttgggccaggctgaagcgggacagccaggacatggttatgagatctctctgcagtgacgaacgcgagggcactcctaccctgtcgcaccgccgtggcgcgtttcgtcgaccgcaggtgccgtccttatgtgcggcataccgcgttcggagtactccgttctgggcagtactactccgcgcgggggcggacgagtcccgattcgtaggcaataaccaccaattgggcccggtcgcgggcgccgagcttggccatggcccggttcacgtgggtcttgacggtcagcgggctgacctccagccgtccggcgatcccgtcgttcgacagcccggccgccacgtgtacgaggacctcgcgctcccggacggtcagcgcggcgagccgctgcgcgtgcgccccggcggcggctccggcggcggccgggtcggcgccgccgccctgggcgaggaaggtggcgatgagccctttggtggcggccggggagagcagggcctcgccggccgcggcgacgcggatggcgttgagcagctcctcgggctcggcgcccttgccgaggaagccggaggcgccggcccgcagggccgagaccacgtactcgtcgacctcgaaggtcgtcagcatcaccacgcgcacgtcggcgagttccgggtccgcgctgatcgtgcgggtggcggcgagcccgtcggtgccgggcatccggatgtccatgaggacgacgtcggggcgggtccggcgggcgagttcgacggcctgcgcgccgtcggaggcctccccgacgacctccatgtcgggctcggagtccacgagcaccttgaacgcgctgcgcagcagcgcctggtcgtcggcgagcagcaccctgacgggtgcggcggagggcgggtccgtcgcgagttcgtccacgagccgagggtacgtgtcccccgtccgcgcgctcagcccagggcgaggacgatcagcgcggtggtcgccgcgacctcggccagggcgccgaagacgtcgccggtgaccccgtcgaagcgccgtacgcagcggcgcagcagcagctccgcggcgagcagggcggccaggaccgccgccgcgctccggccggcggcgggcaggcccatggggagggccgcggccgcggcgagcacgacggtgagcacggtgatcgcggcggcggcgcggcgcgggaccaccccggccacggcggcgccgagcccctcggggcgggcggccgggacgccttcgcggcaggccagggtcatggcgaggcgggcggccacggcggcgaccacggcggcgagggcgccctcggcgcggccgtcggcgtagatctcggacagggcggccacctgcgtgagcagcacgagcaccagggccacgacgccgaaggggccgatgtcggactgcttcatgatccgcagggcctggtcggcgggtttggcgctgccgaggccgtcggccgtgtcggcgaggccgtccagatgcagtccccgggtcagtgcggccggtacggcgacggtgagggccgcggcgagcagcgggcccccgccgagcagcaggaggagcactccgggcagggccgcgagcaggcccacgaccagcccggcgagcggggcgcaggccattccggtgcgggcggcggggcggtcccagcgggtgatgcgcgcgggcagcacggtgagggtgccgaacgcgaaacggacgccgtcggggaacgaggcgcgttccgggggcggcgtctggggcgggccgtcgaacgaatctgtcatcggcgggaacggtacccgctctgcgcgggcggtaaattacccattacatgccaaatagggagtcagtgggatgggtcactggtggtatcggaacatcgtcgaaccggggaagctgccgctcctgctcgccctgctctccttcgtcctgtcgttcctggtcacccgtgtgatcacccggatgatccgggccggccggggccccttcacgaacgtcaccccgggcggtctgcacatccaccacgtggtgccgggcgtgatcctcgtgatcatcggcggcttcggcgcggtcggcagcggccggtacggcttcggcgcgtacgcctcggccgtgaccttcggcctgggcgcgggcctggtcctggacgagttcgccctgatcctgcacctcgacgacgtctactggagcgagcagggccgcaagagcgtcgagctcgtggtcgtcacggccgccatcgtggccctggtcatcggcggtttcgtgcccttcggggtgaacgacctgtccaccgaggagcgccagagccgcggcctggtcgtcatgaacggggccaccaacttcttcctcgcgctgctcgccctgtggaagggcaaggcgcgcaccgcgctcttcggcctggtcgtcccgttcgtggcgctggtcggcgcgatccggctggcccggcccggatccccgtacgcgaggaagttctacgcgaaccggccgcgcgcccgggccaaggccgggctgcgggccttccaccacgaccggcgctgggcgcggccgcgccgcgcgttcgagaacttcatcggcgggaccccggacccggaccgcaccgtctccctggagaagccgcccccgcactgaagacggcggcgggcccgccccccgtcgaagggggcgggcccgccgccgtgctgtcggtgtgccccgtccggagctcagcccgggatcaggccgtcgtcgctgagcatctccctgacctcgtccaatccggcgtccgccgcggggaggatcagctcggacggttccagcgcgtcgtccggcagcggcgtgccgagccgccgtacggcgtcgagcagcgcgcccagcgtccgccggaagccctcctcgtcaccgccctccatctccgcgagcagctcgtcgtccagcttgttgagctcggggaagtggctgtcggccacttccacctggccttcccccatgatgcggacaatcatgacgggccccgtcctactgcttgtcgaaccggtgcggagcctgcggctgctgcccgttgccctgggcgccgccctcgatggcctgctgctgggcggacgggccgcccgccagctcggccttcatgcgctggagctccagctccacgtccgtaccgcccgagaggcggtccagctcggcctggatgtcgtccttggagcccagtccgctctggtcgtcgagcgcgccggaggccagcagctcgtcgatcgcgccggcgcgggcctgcagctgggcggtcttgtcctcggcccgctggatggccaggccgacgtcgctcatctcctcggagatgccggagaaggactccgcgatgcgggtctgcgcctgggccgccgtgtaggtggccttgatggtctccttcttcgtgcggaaggcgtccaccttggcctggagccgctgggcggcgagcgtcagcttctcctcctcgccctgcagggtctggtgctgcacctccaggtcgctgacctgctgctggagcgaggcgcgccgggacagggcctcgcgggccaggtcctcgcggcccagggcgagcgccttgcggccctggtcctccagcttggcggactgcccctggagctggttcagctgcagctccaggcgcttgcgggaggtcgccacgtcggcgaccccgcggcgcaccttctgcagcagctccagctgcttctggtacgagtagtcgagggtttcgcgcgggtcctcggcccggtcaagggccttgttcgccttcgcgcggaagatcatccccatacgcttcatgacaccgctcatgggcttcgcgcgcccccttctagacggactgtgctccaggtcaccgacaggacccacagtacgggccctgtctccattaccgcactgttcgagtacggatgcgctcctcctccaggacgactacgcccgcgccccatcaggcgtaaggagtaggtgatcccaggagaacggacccaccgcacgaaccgtgctaagggaaggacgcccgccgttgccggatcgttccccagcggggtggggcccgtgcccgcaaccacgtaggcttgggttttgtgtttggtagccgctcctccaaggaagagaaggccgccgccaccgacaaggtgagcgccgacctctcgcagccccgtgacccgcaggccccgaagggccgccctacgccgaagcgtgctgtggcccagtcgcagcgcaaggccgtggtggcctcgaccggcaatcgcaaggaggatgccaagcgagcccgtgagcgccgccgtaccgagatggccaagcagcgcgaagcgctggccaacggcgacgagcgctatctgcccacccgggacaagggccccgtccgccggttcgtccgcgacttcgtggactcccgctactcggtcgccgagatgttcctgcccctggcggtgatcatcctggtgctgagcatggtgcgccagccgtcgatccagaccatcgcgctgacgctgtggctcgtcgtgatcgtcctgatcctgctggactccatcggtctgtggttccgcctccgcaaggccctggtcacgcgcttcccggacgagccccgccgcggcgccatcgcctacggcctgatgcgcaccctccagatgcgccggctccgtctcccgaagccgcaggtcaagcgcggggaacggccctgaccggagggacgcccggcgcgtcgggggaaggcttcgccgagggggcaaggctctggctggaaggcctgggcggactgcgcaacgcggtccggcaggagctcgtgggccggcaggtcgacgagcagatcgcgcagcgcttcccggtcgggcagcggctgcgcgtcctcgacgtcggcatgggccagggcacgcaggccctgcggctggcccgcgccgggcacaaggtgacgggcctggagcaggaccccggcatgctcgccgtcgcccgtgaggcgctggcggcggagcccgccgggatccgcgaccgggtgaccctgctggagggcgacggccgcgagaccggggcccaattcctgccgggcagcttcgacgtcgtgctgtgccacggcgtgctgatgtacgtgcccgaaccggacgccatgctggccgggctggcccggatgctggccccgggcggactgctgtccctgctggtgcgcaacggcgacgcgctcgccatgcggccgggcctggacggtgactggaagggcgcgctggccgcgttcgactccaccgactacacgaaccggctgggcctggacgtccgcgcggaccggctggccggactgacggcgaccctgtcggggatcggtgcgcccctgcagtcctggtacggcgtacgcgtcttcacggacggcaccgaggcgggcgaggtcctgccgcccgacgaggagctggagcggctgctggccgccgaggaccgggccggccggatcgacccctaccggggtgtggcggcactgctgcacctgtgcggcgtacggggctgaggcccgcacgacaggcatgaggaagggggcgggccggggatcacccccggcccgcctccctttccctgctgcggctacgcctccagggcggcgcgcaggctcatcgtgtagagctcggtcccgctgtcgtcggacagcttcacctgctcgacgccgccctccagcaggtccttccagtactcaccgacccaggactccgcgtccccctgcgtggtgaactcctcgggtaccaccgacgggctcgtctcggtgccgtcggccgtctcgaaccgccacgtccacgccatgtccgcctccgttgctcgcacgcttcctgccctgagtgtgcccgcagagtaaccgggcgcgcagcagtctcggcgacgcgggaggatcatcctgtggaactcactctgctcggcaccggaacacccgacggcctgccccgccccggctgcccctgcgcggcctgcgcggtctccttcggcacgcgctcccgcgccgccacggccgtcctggtcgacggggcgctgctgctggacctgacccccggggcggtgctggcgggcgcccgggccgggcattcgctggccggtgtgcggcaggtgctgctgacccacccgcacgacgggcccgcggtcgagctgccgcccgggctgccggccgccgggcgggtgccggacgggcgggagctcgcggtgatctccgggcaccgggtgcgcgcggtgccgatggacgcgccgggcaccgggtacgaggtgaccggcccggacggcgcccggctgctgtacctgccgccgggcggggcccccgccgggacgaacaacgggcccacgcagcgcccgtacgacatggtcctcatggatgtgctgggccggcccgaggcgctggcgcggctgcgggcgagcggcgccgtcggcccggccacggacgtgatcgccgtccacctggaccacgacaccacgccgggccgggagctggagcgccggtgcgcggcggccggggcccgggcggtgccggacgggacgaccgtgatcgtcggggagtacccctcggtaccggacctgccgcgccggaccctggtgctgggcggggcccgttctggcaagtccgtggaggcggagcgtcggctggagtccttcccggaggtggtctacgtggccaccggaggcacccgggacggcgacgcggaatgggcgcagcgggtgggcctgcaccgggagcgccggccggggagctggcggacggtggagacgtgcgagctggtcccgctgctggccgccgacgggccgccgctgctgatcgactgcctggcgctgtggttgacggacgcgatggaccgggccggggcgtgggacgacgaggtgtggacggagagcggccggcgccggctcgccgagcggaccgccgagctggtggcggcggtgcgcgcgacccgccgaccggtggtgctggtcagcaacgaggtcggctcgggcgtcgtcccggcgacctcctcgggccgccgcttccgcgacgagctgggccggctgaacgcggcggtcgcgggcgagtgcgagcacgtgctcctcgtcgtcgcgggcctggtgaccgtactcaaggaatagcgggggacggcgcctgcaaggctcgtcggcgaggagccgacggccgctgcggcgacgggggttgccccgctccacgaccgggccggaacagggcgcccaaggcctgagggaaggcctcaccggctgtactctctggcagatgagcacgctgaatctcgacgacttctccgatctgatcgagcgccccgacgggggcgtccggcgtgacgccgaggaacgccgtgagcgcctcgccgtcccgcccggcgcgctgggcaggctcgacgaactcgccgagtggctcgccgccgcgcagggtcgggttccggtcaagccgatcgagcggccccgcgtggtgctgttcgccgccgaccacgggatcgccgccgagggcgtctccgcccgggccgcgtccaccggccacgaactggtgcgggccgccctcgacggtgtcagccccgtggccatcctggccggacggctcggcgcgaccatacggatcgtcgacgccgggctcgactgcgatccggggctgctgcccgcggacgtggtcgcgcaccggatccggcgcggcagcggccggatcgacgtggaggacgcgctgacggccgaggaggccgaggccgcggtgcggctcgggatgcggatcgccgacgaggaggccgactccggaacggatctggtcgtcctcggtgacctgagcgtgggcgggaccaccgtcgccgcgaccctcgtcgccgcgctgtgcgggaccgacgcctcggtggtcacggggcggggcggcctgcccatcgacgacctggcctggatgcgcaagtgcgcggcgatccgcgacgcgctgcgccgggcgcgcccggtcctgggcgaccaggtggcgctgctggccgcggtcggcggcgcggacgtggccgccatcaccggtttcctcctccagtgcgcggtacgccgtacgccggtcatccttgacggtgtcgtttcggccgcgtgcggactggtggcccagcgggccgcgttccgggctcctgactggtggctggccggacaggccagcggcgagccgggtcaggcgaaggcacttgaccgaatggcgctcaacccggtgctcgaccacggcgtcacagtaggtgaaggtaccggggcgttgctggctctccccctcgtccaggcggccgccgcactcgcggcggaactcccggagcgggcggtggaggagccgacggaatgagccgccggggcccccggtcccgaccaggccgaggcccccgaccgcgcaaggacggacagctgcgccccatatgatcgctttttatgggagaggtccgtttggccagcgcagagaccgaccgcaccgccgcaccggcgaccggtccgtcatccggcaggaaagacaccggcggcgatcccgccggcaaggcggcggggggcggccgggagaccggcagggggagcgcccgctcacggcacggagccgccttcgcggtctggtacctgcgcgccgtcaccttcgtcaacttcctcagtgcggtgtgggtttcgctcgggcaggacctgcggcgccacaacgccgaccacttctacaccccgtacatgctcaccgcgggcttcgcctccggcctcttcacgctgatgctcgccgtcaccctcggccgccgcaaacgcgcctcctggatcctcaacctcgcgctcagcgtgtccctggtggtactgctctcccggggtctctacctgaacgagggaatccggcagcacgcgcagaactgggtctcgctcggcgtgaccgcgctgttcgtcggcgccctgctgctgggccgccgcgagttctacgccaagggcgaccgctccaacccggcgctcgccagcgccgtcgccgccgtcggcctgctggccgcctcgctggtcgcggccctgctcgtcggcgccaccaacacctccccgctcagtgccgaggcctccttccccgcgcgctggaagtacggcgtgatgcggctgatcaccctggcccccggcgagcgggcctccgaggcgatcatcacgcccggctgggtggacgtcgccgtcaacgtcatgtcgatgctgctgctgctcgccgtgctgttcgccgccttccgctcgcgccgcgccgtcgacccgatcagcgaggaggacgaggagcggctgcgggccctgctggcccggcagggcgaccgcgactcgctcggctacttcgcgctgcgccgcgagaagtccgtcatctggtcccccaccggcaaggccgccgtgacctaccgcgtcgtcggcggggtctccctggcctccggcgacccgatcggcgaccccgaggcctggcccggcgccatcgacccgtggctggccgaggcccgcgagcacggctgggtgccggccgtgatgggggcgagcgaggaggccgggcagatctacgcccggcacggcctggacgccctcgaactcggtgacgaggcgatcgtcgagaccgccgagttcacgctggagggccgcgccatgcggaccgtccggcaggccttcaaccgggtcaagcgggccgggtacaccgtccgcatccgccgccacgacgacatcccggccgaggagatggccgagctggtgcgccgcgccgacgactggcgcgacggcgccaccgagcgcggcttctccatggcgctgggccggctgggtgatcccgccgacggccagtgcgtgatgctggaatgcaccgacggcagcggcgagctgcgggccgtgctgtccttcgtgccgtggggacccaggggtctgtcgctggacctgatgcgccgtgaccgggactccgagaacggcctgatggagttcatggtcatcgaactcctcgaacgctccaaggagatcgggatcacccaggtctccctcaacttcgcgatgttccggtccgtcttcgagcgcgggtcccggctcggcgccggcccggtgctgcggatgtggcgctcgctgctcagcttcttctcccgctggtggcagatcgagtccctctaccgggccaacgccaaataccggccgatctgggaaccgcggttcatgctcttcgagaagagttcggacctgctgcggatcggtgtcgcggccggccgggccgagggcttcctggaggcccccggccttccgaagtggctgcaccgcagacacctggagacccgccgttgacagcgtggaacaagtccccactgcggcagttcgcccgccgtgagtggggacccatgttctggaccgtccgggacgcgctcgtccgcgacagatggcgggcgatcccgatgaccctcggcgcggtctgtctgacctcggtcttccagatcgtgcagaacacctcctgggggttccagccggtccagaacctcggatcggtcaaagccgccgacccgctcgggctggccctcctgcgcaccccgctgtccctgttcgtccccgccctggacctgccggtgtggggggcgctcgcgcagatcctgctggtcttcggcatcgccgagatctgcatcggctggtggcgcaccctgctgatcggctacgtcgccaccctcgccgggaccacctacgcacggatcgggctcgcgctcgggccggagcacgccctcggcctgccggtgtccgaccggatcgtcaacgacaccgggccctcggcggcggtcgtgggcctggccatctacgtgtgctggcgctaccgggcgtacctgaccggcgccctggtgatcctcgtgatgatcggcgaagtgctggtcaaggacaacctcgccggcaaggagcacctggcggccatcgccgccgtcatggcggtgtgcgtggtgcgggcgcgctggggtccggtgcggtcccgcgtcccgctggggcaccgcacgccgccgtagcgggcatcggcgggcgaggccgtaccgtatccgggtgacgacagatctcgggccgttcgcccccacccggcagtggatgcgggcccatccgctcgccaccgacgccgtgctggcgttcggggcgttcgtcgccatggtcgtcggctccttcgccagtccgcacgggccgcacgggcccaccttcgggacgcgcgcccccgagccgttctcgctgctgctgatgctgctcggcgcggccgcgctggtgttccggcgccggcgggcgctcgccgtgctcgccgtgacctgcgggctgtccctgctggagctgaccaccggggaaccgcgggcgcccgtcgccatgtgcgcggtgatcgccctgtacacggtggccgcacggaccgaccggccgacgacctggcggatcgggctgctcaccatggcgggtctgacgggcgtcgccatgctggccgggccgctgccctggtacgcgcaggagaacatcgggatcttcgcctggacgggcatggccgcggccgccggggacgccgtacgcagccggcgggccttcgtcgacgccatcagggaacgggccgagcgcgccgagcggacccgggacgaggaggccaggcggcgggtcgccgaggagcggctgcggatcgcccgggacctgcacgatgtggtggcccaccacatcgccctggtcaacgtgcaggcgggagtggccgcgcacgtcatggacaagcgcccggaccaggccaaggaggcgctggcgcacgtacgggacgccagccggtcggcgctgaacgagctgcgggccacggtcggcctgctgcggcagtcgggcgacccggaggcgccgacggagcccgcgccggggctcggcgtcctggacgagctggtggacaccttccggcacgccgggctgccggtggaggtcatcgtccagctggacgggacggcggaggcgggggcgctgccggcggccgtggacctggcggcgtaccgggtgatccaggaggcgctgacgaacgtgcgcaagcacgcgggatcgggcgcgaaggctgaggtcagcgtggtgcgggtggggccgtcggtggaggtgaccgtcctcgacgacggcggcggctcggccggcccgggcccggaaccggccgacccgggcggcgggcacggcctcctcggcatgcgcgagcgcaccggagcactgggcggctcctgcttcgccggcccccgctacggaggcggctaccgcgtccacgccatcctccccgtgggatagccgtctcctcctcggcccgaccaatcccagcctcgccggcgtttgaggcgcggggtctggggcggagccccaggaaacccggctccgccgggcaggctggatggggccgtggccgacctgaaactgccggcgaggctatgggcagacctggcgccacgcgtccaggtcgtaccgtttctgcatcgagctcagcttcgccgcacgggcccgcgggcaccagcggctcgggcgaccctcgtactccacgtggaacaccgccttgcccgcgtcggtgaacggcgcgtaccggtcgcactcctcgtactccacgcactgctcgttcaccgcgaagtcgaagtccccgaccagctccgggatctggtccaggtcgttcttcagccccaccgacatgccccggtcgtgcgccagccgggcgatcaggcggttgtacttcagctggtcgtccgcggtcagcgggaaaccggaccggttggcgtagccgtccatgttgtcgggctccaccgcgtcgaagcccttcgccttgcacatgtcgaaccgcttggccatcagcggttccagttgcgccagggcccggatgtccagccagcgttcgccgtcccagccgttgccctcgcccagcagtgccttcgggaaggcggccgcgtccggccggaagtcctcccaggcgccggtggagacgtagcagatggtcttgcggccggccttcttcagggtggcgagctgctcgttcgtggtgttgaacccgtcgacgtcgtacacggccgccttcaccgaggtgtcgagcttcccggtgagctgccactgccacccgaccccaggcttcggctgccagcgctcccccggcgccgggtcgggcgacagctcctcccggtccggttcgggcggcgggctcgtacaggcggcgagcagcagcaggggcacggccagcaggagtgcgagcttcctcatcccgccgcctccagcgcgtacgggagggtcccccaggggtgcgcgccgctgccggggaccgcgcagtgcaccccggccccgcgttcggcggcgagttcctcggcgagccgggcggcgagcgcgcccggcgggaccgcgtacaccaggtggcagaaccgctgggccgggtggtcggcggtccagggcggtacggcggccgcgtcccggtaggcgtcccaggggccctcgaaggtgacgagcaggtcggcgagttcggcgtagccggggtgcgggtggaccccgtggttgaggacgagggtacgggcgcccgcggcccgggccgcgaccgcgagccgcccgtagtgcgggagcagttccggatcggcggaggcctggtcgaggaaggccccgtcggtggcgtaccagtcgcggtggcgcaggaggtcctgcaccacctccgcgtgcgggcgccgcccgtagtcggtgtcggcgtacccgaggacgggtacgccggcctcgcgcagccgctcggcgacgacggcgaaccgttcgtcgcgggcggcgcccggtccgctgtcggggttgaggaccaccgaatgcagccggcctgcggagctgatgagccgctcccaggcttccggccggtcgtcgggatgctcgtagaggggcaccagcagcatggggtccttcttctcggacggacggtgcgtcatcggtgggcggtcgcgcggccgagcagcaggcagaccagggcggccagtacggtggcggcggcgcccgccaccagcagctggaccgcccggggctggcccagcccggtcagcagggccaggctctgggcgacggcggccgaggagcagacgacggccgcgggccggaccgccccgaaggactgcaggagcagcccggtccacatcacggccccgagcagcagcagggtcgcgatccggaccccggtgaggacgggggcgccgggccagaggagggtgccggccagtcccagggcgagcaggacggtcaggtagacggcgaggcagcgggtcagggtggcgagcatccgccgccggaaggcccggggcgagcgggccccctggagcccggagaggctcccgctgcggaaccggtggagcagccattcggccgggcccatgctgagcgtgagggccaccgccgagggtgcggcgacggcctcggcggggcctcctgcgaggacttcgccgagggcggcgtacagcacgagcaggccggtgccgaggccgaagacgccgtaggggaccgagtccccgatccggggtccgcggggtgcgaagtcctcctcggcgccgcgcagcatctgccagcggacggggccctggccggggcgtcgggcggccgaggcgcggatccggcgcgcggcggcccgcagcccgtcggccagcgggagttccctcagggccagggtgcaggcggccagcagggacaccacgagcagggtcacccggaccgggacgggcaggtcgacgaagagcgcgagcagcgccccggcggccatcgggccgagtgcggcgagcaggacgcgttcccggccgaggaccagcaggacggtggcggccccgacgtagagggcctgtccggctgcgaaggcgtaggagaacggcggcccgccgggcaccgccagtgcggcggcggtgcccagcagggcgccgacgggggcgccgacgagcagggtccgcccggcggcgcgccggtcgccgaggccgagccaggtgtaggcccggtgggacagggtctggtcccagacccagccgatgagcgcgcccgcgagcagggtgagcgtcccggcgggcaggccgaggcggtcctgcgggccttcgagcaggggcgcgccgagcaggtacgccaggccgggcagggcgaagatcaccccgcgcagcaggcaggcggtgagggagaccttccaggggtcgggggcggcgcccggctccgggaaggagcggggcacccgggcgtagagctcctcggcgagtgcgaaggagtcgtgccggccgtaggtgagccggatgtactcgtccgtcatgccgtcggattcgaggatggcggcgatctcgtcggggtggacggcggaggcgatgaacacgtcgaggcgttcggcgagttcgtccatcgggtcggccgcggcgtcggcggccgtgatgtcgcctccgccgtcgcggcgcggccgggggacggccgggagcgtgtcggtgccggaaccggggccggaaccgggcggcttgagccagagggatccgctcaccacaggctcccgtcggcagcgagttcgcggtaccagggatcggcgagccgctgggtccacacgtcgcccgcgtggacgggcaggacgggctggccggcgagttcgcggtagatgtgccggaagccgtcgacggactggtggagggtgaacttctccacgacccgcttgcgcgacatccggccgagttcggcccggcgcccgtcgtcgcggagcagggcgagggtggcgcgggccatggtctcgggctcgcgcggcggtacgacgaggccggtgtcaccgacggcctcgcggacgccgccgacgtcggtggagacggtggtgcggccgcaggacatggcctcgatgatgctgaaggggaagccctcgctgatggaggagagcatcacgacgctgccggccgcgtaggcctgggccacctgctcgatgcggccctcgtaggtgatgccgtcggtcacgccgagttcggcggcgagcttctccaggcggagcttgtactcctcgcagccggccggcacggggccgaagaggcgcagccgcagggcgggaagctcctcgcgcatgaaggcgtaggcccggatgagggtttcgaggtccttgatcgggtcgatgcggccgcaccagctgagggtgggcacgtccggttcggggccggcctcggggaaggcgtgcgggtcgacgccgttgtagacggtgcggatgcggtcggactcggcgcctccgcgctcctcccagcggcggttgtactggttgcacggggtgatgaggtccgcctgccggtagccctcggtgttgagctcgcggtagaagccgagcatgagcgccttgacgggccagcgctgggcggcgctgcggtagccgaggtagcgctcgcgcaggtagatgccgtgctcggtgaggaggaaggggaccccgtcgaggtatttggcggcgagggccgggagggtggcgaggccgctgctgacggcgtgcgcgacgctgtcgggcgggatccggacaccgagcgggcgcagcgcgtgttccagcaggtcggtggcggtgagcgcgtcgtggatggtgggcgcggcctcggcggtgacgagtccgggccgggtccatacggtcatcagcaggcgcaggaccgattcggagcgcagggccggtgcgagttttcctgccctggccaggacggccagttcgcgcagggcctcggagaagctgtgccgggcgggatcgggctcggggtcgagcagggagagcaggaagctctcgtagacctcggtgaagtggcggtgggccttgccgcgcaggccggcccggcggatgcgggacgggagcggcccccagagcgggaaggcggtgtgccggtagacgttgcggggcaggtcccaggtgaccggctcgcgtccggagccggtcagggctatgacgttgaagtcgacctcgggcatacctcgtaccagttggtcgcaccaggtgctgacgcccccgtggacgtgcgggtaggtgccttcggtgagcatggtgacgtgacgcccatgactcatgcggtgtgtccccccaggacggaaaaggggccggcgcccgtgggttcgcggagcgccggcgctaggtggtactcgtggtggcttgcgggaaggtcagctgggcagcttgagcgtgacggcgctctggagcagctcgggaccggcccaggcggagcgggtaccggcgtacgcggtgccgaagtcggcggtgccgagcagcagctgcttcttggtgccggtgggggcggtcaccggggcgacgaccccggcgggcgccttgatggtgacgtccttgccgatgcggtaggcggtgaccttgccgtcggcgagggccttgtcccaggcggcgcggcgctggaactcgacgccggtgtccttcatgctctggttgacgatcggcgcgctgggggcgtagagggcgcggtaggtgtcgaggacctggttgagcacggggtagagcgtccggtcctcggcgaggttggactggtggacgtagtgcggccgggggtcgttggcgaggacgtggcgcagggccgtgcgggcctcggccgggacgatggtgtcgaggtagccggtgttgacgttcaacggggccggcaggcaggtggaggtcgccgggttgtcctcgcagacgccgctgccgccgtgggcgcggctggtgtagatccagttgtactcgtcggccatctcggcgttggtgcccgtgttgtagtacacgttcatcgggtgccgggggaccgtgagggccgcgccgaccgcgcgctgctcgggctcgcgggagttgtcgctgcccgcccacttgaccccgttgtcggcgagggcgccggccaggttggggttgtcgacgggctgctgcggtgcggtcttgaggccggagtgctcaccggtgaccagttcggtcttgtccgtggtgatgcccttgccggcggcccagttgttgttgtcgcggatctggccggagatctcggcgcggctcatgtactggatcgcgcccgcggcgttcttcgtacaggtccagggggtgacggcggtgttctggacgcatccgaggaacgggtgggtgtaggtgtggttcatccaccggtacttggcgcggtcggcgacgagctgggcggtcagcgcgtcgacgccgccgttctcggccttccactcctccccggcgccgccgttgaagagcatgtcgagcttgaagctcttcgacgtctgccactgcgccgcgtacacggcgtcggcggcggtcatccggatggtgctctccttgccctcgccgcccgcgcaggcgtagtcgccgggggtgcagttcaggtctttgttccagcgggcgtcgggggcgaagacatcgtcgacgtggaccgcgaagtagttgcggctctggccgaggtgcaccccctgggtcagccagtcgacgatgccgcgggcgaggaggcggaactgctgctggtactggttgtagccgaaggtgacgaccagttcgctgcggccgtcgtgcgtgtactcgccgacgagcgaggcccggccggagccgacgggcgcgtcaacgtagctggtgtagccggggcgcggcttgcccatgaagccgaagctctcggggaccagggccgagttgtcctcgaaggcgacctgcccgccgaggtaggcgaacgggccggccttgccggcggtggtgacggcggcctgggtgccgtcgagctggccgctgtagccgccgttgtcggtgtattccagcccgacgcccgggtgggcccaggtgtaggcgtcgacctggcggatgccgtaggtcgtctcgtaggcggtgagggcggccatctcggccgagccctcgccgaacgggttctcgttcggcaggacgacaccctggtacttggcgcgcggacggccgtccacggtgtcgctgaggaagcccgcgttgatgaccgggcggccgctgccgcccagctggacgcgggtgtagggcacccccgtgtcgcggagctccgcggtgatcgcctcgaccgagctgccgccgtcgtcgacgaccagcaccttcaggtcgatgcgcggtgtcgcggccgcctgggcggtcgcggcgggtactgccacggagaccagggcggccgccgccatcatcgcggcaaccctgttcatccggttcttgttgaccattttcggcctttccccccgcaggcatccctcgactcggcccttggcggacagccggacctgggaggctctgtggaaatcatgcaaaggaaccccgcgtccccttgcgagagtggaccgagtctttcggacctcgtcaggtctacggggcaaacctggagcagagtccacagatgggtgaacctgatggcctcttgatcgaacaacttgccaaaccttcgagtgacgtacggacgagcgcgtacgcgtaggctcatttctggcggctgtcgggcccgaatacgatcgctacggacggccgtccacccactcggcccacacacacaaacggaagcgagacttcaccaccgtgactgctctgactctcagcactgccggcgcggcgacgctccgcgccgacgccctcgtggtcggcgtggcgaagggccccaagggaccgatcgtcgccgcgggcgccgaggccgtggacaaggcgttcgacggtaagctcgccggcgtcctcgacgcgctgggcgcctccggcgccgaaggcgagatcaccaagctgccggccccggcgggcctcaaggttccggtcgtgctggcggtggggctcggctccgtccccgagaaggacgagtcgttcgacgaggaggtgctgcgccgcgccgccggcgccgccgcccgcgcgctgcacggcagcaagaaggccgccttcgccctcccgctggaggacgcctcggccgtcaccgccgtcgccgagggcgcgctgctgggcgcgtacgccttcaccgcctaccagggcggcgagaacaaggctcgcaaggaggccaagggcgcggccccgaaggccccgctggccgaggtggccctgctgggcgccaagccgcgcgacaaggagcacaaggccgccgccgagcgcgccgcggtcgtggcggccgaggtcaacgtcgcccgcgacctggtgaacaccccgccgaacgacctgacccccgaggccttcgccgcgatcgcctccgcggccgcgaaggagaacggcgtcaaggtccaggtcctggacgagaaggccctggtcaagggcggctacggcggcatcatgggcgtcggcaagggttccgagaacctgccgcgcctggtgaagctcacctacacgcaccccaaggcggagaagaccctggccttcgtcggcaagggcatcacctacgactcgggcggcatctccctgaagccggccggccacaacgagacgatgaagtgcgacatggccggcgccgccgccgtcttcgcctccgtcgtcgcggccgcgaagctgggcctgcgggtcaacgtcaccggctggctcgcgctcgccgagaatatgccgtccggctccgccaccaagcccggtgacgtgctgcgcatgtacagcggcaagaccgtcgaggtcctcaacacggacgccgagggccgcctggtcctcggtgacgcgctgaccaaggcttccgaggacaacccggacgcgatcgtcgacgtggccaccctgaccggcgccatggtcctcgccctgggcgaccgcaccttcgggatcatgtcgaacgacgacgccttccgtacgtcgatccacgagatcgccgaggaggtcggcgagtcctcctggccgatgccgctccccgccgagctgcgcaagaccatggactcccccaccgccgacatcgcgaacatgggcgtccgcatgggcggcggcctggtggccggtctcttcctgcaggagttcgtcggcgagggcatcacctgggcccacctcgacatcgccggcccggccttccacgagggcgcgccgcacggttacacccccaagggcggcaccggctccgccgtccgcaccctggtgcggctggccgagcgcacggccacgggcgacctgggctgaccaccacgtgtgatgtgacgtgacgcaccccgggccgggtcagggcccggggtgcgtccgtttaccacgaaacctgaaggaatctccaggtatcccggtaggtatctacgcacaggtaacccccggtccgggcggatcgcccgatcacatcgtgggcccggcgtcccgcgttcccccgacaaatgcgaagatgggttctcggcaggacagggcccccaccacagggccgaagaaacaagcggccgtataccagccgccgcccggtcacagaggaccggtgcccggcgcacatgcatggaggacgtgacgtggcgaacgacgccagcaccgttttcgacctagtgatcctcggcggtggcagtggcggttacgccgcggcgctgcgcgcatcccagctgggtctggacgttgccctgatcgagaagaacaagctcggcggcacctgcctgcacaacggctgcatccccacgaaggctctgctgcacgcgggcgagatcgcggaccaggctcgtgaggccgcccagttcggtgtcaagacctccttcgaggggatcgacatcgcgggtgtccacaagtacaaggacgaggtcatctcgggcctgtacaagggcctgcagggcctggtcgcctcccgcaaggtgacctacatcgagggagagggccgcctctcctccccgacttccgtcgacgtgaacggccagcgcatccagggccgccacatcctgctggcgaccggctccgtgccgaagtcgctgccgggcctgaacatcgacggcaaccgcatcatctcctcggaccacgcgctggtcctggaccgcgttccggagtcggcgatcgtcctgggcggcggcgtcatcggcgtcgagttcgcctcggcgtggaagtccttcggttccgacatcaccgtcatcgagggcctcaagcacctcgtgccggtcgaggacgagaacagctcgaagctgctggagcgcgcgttccgcaagcgcggcatcaagttcaacctgggcaccttcttcgacaaggccgagtacacggagaacggcgtccgtgtgacgctggtcgacggcaagaccttcgaggccgaggtgctgctggtcgccgtgggccgtggccccgtctcccaggggctgggctacgaggagcagggcgtcgcgatggaccgcggctacgtcctggtcgacgagtacatgcagaccaacgtgccgaccatctcggccgtcggtgacctcgtccccaccctccagctcgcgcacgtcggcttcgccgagggcatcctggtcgcggagcgtctggccggcctcaaggccgtcccgatcgactacgacggtgtcccccgcgtcacctactgccaccccgaggtcgcttccgtcggcatcaccgaggccaaggccaaggagatctacggcgcggacaaggtcgtggccctgaagtacaacctggcgggcaacggcaagagcaagatcctcaagaccgcgggcgagatcaagctcgtccaggtcaaggacggtgccgtggtcggcgtccacatggtcggtgaccggatgggcgagcaggtcggcgaggcccagctgatctacaactgggaagctctgccggccgaggtcgcgcagctcatccacgcgcacccgacccagaacgaagcgatgggcgaggcccacctggccctcgccggcaagccgcttcactcccacgactaattcgtcacgggcgcgacgaccacttccgcacattcgttaggagcaactgaaaccatgtcggtttccgtaacccttccggcgctcggtgagagcgtcaccgagggcactgtcacccgctggctgaaggccgagggcgagcgcgtcgaggccgacgagccgctgctcgaggtctcgaccgacaaggtcgacaccgagatcccctcccccgtgtcgggcatcctggcctccatcaaggtcgccgaggacgagaccgtcgaggtcggcgccgagctggccgtcatcgacgacggctccggcgctccggccgccgcggcggctccggccgccgagccggccgctgccgccgaggcccccgccgaggcccccgccgccgctccggccccggtcgccgaggcccccgcggccccggccccggtcgccgaggcccccgccgcggaggccgctccggccgccgccggcaccgatgtcgtgctccccgcgctgggcgagtccgtcaccgagggcaccgtcacccgttggctgaaggccgtcggcgagtcggtcgaggccgacgagccgctgctggaggtctcgaccgacaaggtcgacaccgagatccccgcgccggtctccggcaccctgctggagatccggatcggcgaggacgagaccgccgaggtcggcaccgtcctggccgtcatcggcgtcgccggtgccgccccggccgccccggctccggccgctgccccggctccggccgccgccccggcccccgtggccgctccggctccggccgccccggctgccccggtcgccgctccggctccggtccaggccgccgccccggtcgccgccccggctccggtccaggccgccgccccggtcgccgccccggctccggtcaccccggctccggccgctccggccgccgcgccggcgtccgccggtgacgaggccgcgtacgtgaccccgctggtgcgcaagctcgcctcggagtccggcgtcaacctgtccacggtctcgggcaccggtgtcggtggccgtatccgcaagcaggacgtcctggccgccgccgaggccgccaaggccgctgccgccgccccggcgccggccgctgccgctccggccgccaaggctccggccgccgcggtctccgagctgcgcggtcagacggtcaagatgacccgcatgcgcaaggtcatcggcgacaacatgatgaaggccctgcactcgcaggctcagctcagctccgtggtcgaggtggacatcaccaagatcatgaagctgcgtgagaaggccaagggcgcgttcctggcccgtgagggcgtcaagctctcgccgatgccgttcttcgtcaaggccgcggcccaggcgctgaaggcccacgcggtcgtcaacgcccggatcaacgaggacgagggcaccatcacctacttcgactcggagaacatcggcatcgccgtcgactccgagaagggcctgatgaccccggtcatcaagggtgccggtgacctcaacctggcgggcatctccaaggcgaccgccgacctggccgccaaggtccgcggcaacaagatcacgccggacgagctgtcgggcgcgaccttcaccatcagcaacaccggctcgcgcggtgcgctgttcgacacggtcatcgtgcccccgaaccaggtcgccatcctgggcatcggtgccacggtgaagcgcccggtggtcatcgagaccgccgagggcacgaacatcggcatccgcgacatgacgtacctgaccctgtcctacgaccaccgcctggtggacggcgcggacgcggcccggtacctctcggccgtgaaggcgatcctcgaggccggcgagttcgaggtcgagctcggcctgtaaggctcacgcccccgcggcagccactcgatgcggcgccccctcccggaacaccctccgggagggggcgccgtcgtcatacgctgactggtccagcaacgagtcggcgggggcgggcggcatgacacgcgcacgggtgaacgatcttgtagtggtactgccggggatcatgggcagcaggctggcgaacgccgacggcaaaccggtctgggacctgtcgggcggcgcgctgggacgggccctgcgcaccttcggcggctcggtgaagaacctgcgcctcccgaaggacatcggcgacgaccatcccggcgacgcagtggtccccgtcggcctcatgcccgacgtgcacgccctccccggcatctggcggccgatcgacggttacacggatctgctgggctggctggagcggtccttcaccctgaccctcggggagaacctggtccccttcccgtacgactggcggctgtcctgccgctacaacgcggagcggctgaggaagaccgtcgcccgcgcactgggccgctggcaggactcggcgcccgagcgccgcgacgcccgagcggtcttcatctgccactcgatgggcggtctggtcgcccgccattacgtggagctcctcggcggccacgaaatcacccgccgcgtgatcaccctgggcaccccgcaccgcggctccctggacgccctggtccacctggtcaacggcctccgcaagggctggggcccgctcggcgtcgacctgagcgccttcgcccgcagcctgccctccctgcaccagctggcccccgactacgcctgtgtgacgggcccggagggcctcgcgtacgcccgcgacctgccgggcctgccgggtgtggaccccgcgctgctggcggacgcggcccgcttccacgcggacctgcgcggggcggccgaccggcccgcgccggtcccgctgcacgccatcaccggcatcgcccagccgacgctcaccacggccgagctcacgggcgacgtcctgaccccgctctggctgatcgacggcgtcgacgaacgcggcgacggcacggtcccgcgcctctcggcccgccccaccaacgccgagaactccggctacgcggtaccggagtcccacaccccgtgcgaacagcacggctccctccagaacaacaggggcgtacgggacgccctgcacggcctgctgggccacgagccccccttccaccgcggcgaggaggacaccgatgtcctgctgggcgtcgtggcaccgtccctgctggagccgggcgatccgtacgaggtcgatgtcacggttccgccggaagcgatcggcacgacggaactccggatcgacgccgtcctgtgccctgccaatggcacccgctctctcaccagccccctgcgtcacttcggcggtggccggtacgggaccacgttcccggcaccggagcccggcgcttatcgcatggtcgtacggcgtcgggggcgcgcggagtccgcggtcacatcgctgacgctagtgggtgaatccggtgaatgacaggaaccaaccgcgagggaccgtggtcggtgtcgtggtgggaagccgcgggtcggcccgctccccggacacggcgcgcgccgcggatgaggtacgggaggtatggagcctgctggagcggcacggattcacgccgataacggtggcggagccgggcggatacccgttcgaggagggagcggccggcgggcggaaacgatcgagcatctacgaggggcacggcccggcgctcgtcctgtggtcggcccacggcgggcccggccgggcaggagtgctgcctcctcatggcactgaggaagcccaaagcgatggcaacggggtggtgaacaggcatacatccgctgactggtccggtgggacggaccaagtgctcatgctgatcgacaccggcgatgtgggtgccgacgcgggggtggcgctcgagaacgccctgcggacgctcgaggagcgtggcttggtgccgggccgtgcggcgtggctcggagtcgtcgcgggcagcggttccaagggggaatccgcatcgggtgacacgcttgcacgcaccctcgcgagggtcctcggcgaggacgtacaggcgccggtccaccggcacgaatggagccagcaccacgcccacatcagcggaccggcagtcatcgagcctgttcaagcgtcgtggacccgcagcagaggaggccggcccgcatccgccgccgacggccctaccccgcaggtgttcgaagcacccgccatccttccgtatccgaccccgggacccctcgtgcgggcggcgcagggcatggatccggaccttgaagatcggttcttcaccggtcgtcaccgagtgctcagtgacatcgcacactggttggaggatcggcagcctggaattttcctcctgacaggcgcacccggcagtggcaagtccgccgtgctcggaagaatcgtggctctttccgaccccctgcagcgggcagaccttctcgcgcacggcgctctgcggccgggtgaccccgaccccggcgtcaacaccgtggatgtctccctgtgtctgagcggcctgaccgtgcatcagctcgcctcggccgtcgcggacggattggggctccctcgcccgcccaccccgtcctccttgatcgcagacctggaaagggggtggtcgcgatccggtcagcgcctggtcatcgtcatggacggtctcgacgaagcagccccctacgaggccgacggcatgctggaccagttgctggcaccgctgagccgccaggcatgcctgctggtgggctcccgcgaccgcccgctgcgttcgtctgccgaacgcggggagtcactgtctcaagtggtggtgcgtctcttcggcagccgtgcacgccatatgagcctggatgaggcgcctgaggccgaaagcgacatcgaggagtacagccgccgccgtctgcaggccgaaggtctgcccctcggggaggccgccgccgcttcccgcgtgatcgcacgacaggccacgcagggccacggcggcttcctgttcgcccgagtggccgccgattccgtgatccggcgccatcctgcgggcccggaggactgggagcaggcggtccccggttccgtccgggcggcgctcgcgcaggacctggagaagggaccgacgcttgtgcgggacggtcaggtcgtaccccacgccgcgcgggacctgctgaccgccttggcgtggagcagtgggaacggcctgccggccaggggcatctgggaggcgacggccacagccatcagcgacggcgggacctcgtacggtcccgccgatctggattggctcctcggtgcctacggtcgatacgtcgtggaggacaccgacggcgaccaaccggtctaccggctctaccaccaggcactcgtaggccatctccgagacatgtccgctgcgggacaccggcgcggcagagccgagccggcttaccgtgtcgcacgggctttggtcgacctgctgctcgggcatgccgatgacgccagaacggcgaacccttacctgcggagagccttgccggagcacgctctcatggctgaaggcagaggtatcgacctcgtccgtgaactcgtcgagacacgtggggacgccttccggccagatctggcgcaggccctcacgagggtggccgcctcgctgtccgaagccggtcgctgggcagaggccgtcgccccatctcaggaagcgacctggctgtaccgggagctcaccaagggcgaccggggctcttacctgcccgacctggcgatgtcgctgaacaacctcgccatccaccagacgatggctggggacaggcaaggcgcgctggtcgcggccaccgaggccgcctcgctgcaccgcactctcgcagattccgatccgtcggcctacctgcccgacctcgccgcatcactgaacagcctcgcgcgttcccaggcccagtccggcgaccggcacggtgcgctcgccaccatcaccgaagccgtcaccatccggcgcagcctcgcccaccgcaactcagcctcgtacgtacccgagctcgccgcctcgctcaacaacctggctgtccaccaggcagcggccggggaccgccacggcgcgctcagcgccatcaccgaggccacatacctctaccgcagcctcgccgaggagaaccccgccctctacctgcccgacctcgccgcctcgctcaacaacctggctgtccaccaggcagcggccggggaccgccacggcgcgctcagcgccatcaccgaggccacatacctctaccgcagcctcgccgaggagaaccccgccctctacctgcccgacctcgccgcctcgctcaacaacctcgccaaccagcaagccgacgtcggcgaccaccacggcgccctcaccgccatcaccgaagcggtcatcatccggcgcaacctcgccgaggagaaccccgccgcgcatctgcccgacctcgccgcctcgctcaacaacctcgccaaccagcaagccgacgtcggcgaccaccacggcgccctcaccgccatcaccgaagcggtcatcatccggcgcaacctcgccgaggagaaccccgccgcgcatctgcccgacctcgccgcctcgctcaacaacctcgccaaccagcaagccgacgtcggcgaccaccacggcgccctcaccgccatcaccgaagccgtcgcgctcctgcgcaacctcgcgcaggccgacccccacgcgcacctgccccacctcgcagacgccctcaacaacctcgccgcccaccaagccgggaccggggacagccagagcgcgctcgccaccgccaccgaagcggtcgggtactaccgcgccctcgccgcacacaaccccgccgcccacctgccccacctcgccggcgccctcaacaacctcgcgcgcagccagaccgaatgcggagaaccggatgccgcgctcgccgcgatctccgaagcagtcggcctctaccgcaccctcgcgcaagacaaccccgccgcccacctgccccacctcgccggcgccctcaacaacctttcggttcacagagccgtgaacggggaccggcagagcgcgctcgccagcgtcgaggaggcggtggccatccgacgcgcattcgccggcgccaatccggccgcacaccttcacgatctcgcggtgtcactgcacaatctcgccgtccaccaagccgggaccggggacagccagagtgcgctcgccaccgccaccgaagcggtcgggtactaccgcgccctcgccgcacacaaccccgccgcccacctgccccacctcgccggcgccctcaacaacctcgcgcgcagccagaccgaatgcggagaaccggatgccgcgctcgccgcgatctccgaagcagtcggcctctaccgcaccctcgcgcaagacaaccccgccgcccacctgccccacctcacggacgcactcgacaacctctcccgcgtcgcccctcttgagctggctctcacagtccacagggaggccgagcaggcgctcggcactcaccccgaggccgcccgccgcctggctgtcaggcgcgccgagctggagctgacccatgcggactccgacctcggtctcagcagcctcatcaccctcgcttcgccccagcaagcatccgagggcgaaggaacagccaccttccaggcccggcagaggctacggacccacagccggacggccgccgcgaacgccgaacggatcgaggccctctggcgcgagctcacgcgtacggaacccccggcgtggttccggctttcccaggagacgctcgaccgcgccattgagtggatccggtgccccacctgggcagcctcccgatccttctgggatgcacacgcggaagagcttcaaaccagtgacagcacgctggccctggaggagatcgccctgaccgaccggagcgcagcagagcatctggagatcgcccgggcagcggtgacagcaggccctgacagcgcattccgcccttatctcaccgccgagctccttgtggcgtggaccgatctccccacctgggaggagtcccaggcatacctcaccgaccacgcggagatcctccttcacgaactggccgttgatctccttcgttccgacctggacgcaccggaatctgccgtgggcttcgcggtcctggtcctctctcgtgcgatcggcatcgcgtcggcgtacgagtgcgtcaagagccgtggccgtctgcaccgtcaggttcaactggccctcgcctccgatgagcccgcgcccgaggttctccgtgccgccgccctcctggagctcttcgtctaccaggaggacttcaccggcgcggcacatctcgcgctcgcctcggtcctcgacgggtcctctcacgaccccccatcgtggcctgccgccgaacaggccgaccgcgaccgtgtcatcgccgaaatcgcctccgtcatgagtcggcatacgcagcatgagtcgcccttgggcgccctgatcgtgagcatcctggcggcgagccctgcctcatgagcgaccccgcccgcattctcgtcgtccaggcggcgtctccccgcatcgccggagctcccgatgtggccgccgagtaccgggacatccagcgcagtatcgacgcagccccctaccgccaagccgtcagtcacagcatcctggcagccgtccagttgaacgacctgaccacgcagctcatccgcgaggtgcccgccgtcctgcacatctcggcgcgggggacccccggtgggggtcttcgcctgctcaccgaggatggtggtgacgcacccgtgcgtgacagcgggctggccaagctgctgtgcgacttcgtcgaggacgggcttcaggtggtcgtgctcaacgcctgctggacgtgggagctggccgagatgctggccgcggcggtgccgtgtgtaatcggcacaggcggccccattgacgatcgggagtgccgcgcctactcccgaaccctctacagctcgctcgcacacggacgctcggtaggccagtcccatcggatcgccgttcatgaggcggatgcctccggggctgatcctgactgccttcccgccctgctcaacaggtccgacgtcattcccgacgctgtccacctcatcgctccggaattccgcgtcccgcctgtccgtacccccgtcaaaccacagggcgggacgagaggatggcttcgtatgggcaagaagccgaggctgtaaccagcctcacccggggtccccgccccggaacacctcactcagggctactcggccgtattgtctacgcatcgaagcgatgcatgcccctacaggagatgaagccccgatgatcaccccacccgtcgtgcactcgctgcgcgagcagatccgcgagcacatcgtggaggggatcgtcagcgggcgctggaagcccggcgagcggatcgtcgagcggcggatcgccgtggagctggaggtcagccagaccccggtacgcgaggccctgcgcgagctggagacgctgcggctgatcgagtcggcgccgaacaagggcgtgcgcgtgcggaacctgtccgcggccgacctggaggagatctacccggtccgggccggtctggagcagatcgcggccgagctggccgcgccccggctggcgagcgactgctcggcgctggagccgcatgtggcggcgctgtgggaggccgaccggaccgaggacgggaccgcgcaggtgcggcacaccgtcgggttccaccgggagatggtgcgggcggccgggaacagcgtgctgctgcacacctgggagagcttgggcatcgaggtgttcacggccctgtccatccgctggctgggtaccgtccagaagtcgtacgccgaggagcacgaggcgctcgtacaggccttccgcagccaggatccggatatcgggctgctggtgaagcggcatgttctggggtgcgccccccgcgcctgagcggatcatttgtcccagtttgcccggcaccgcgtgcctttttctctggcacgcggtgccgacttttgctcgatggacgtttcttcgtcactttcatttgatcgatcatcgatcagcgatttacagtcgtcgcggacctcaaccaggtccaccgaccctgtcctgcccgtcagggattttttcaccacctctcctttgtccggaaggcggcgcacagcaatgtccgaccccgtaggaaagcttccgagcgagctcgaccagctcccggatcgcgacaccgaggagaccgccgaatgggcggcctccctcgacgccgtcgcacaggccgccggtacgcgccgcgccgaatacctgctccgccgcacgctccagcacgccgaggccgccggcctcgccctgcccaagctgctggagacggactacgtcaacaccatcccgaccgccgcggagcccgagttccccggtgacgaggagatggaagccaggatcaccgcatggaaccgctggaacgcggccgccatggtgacccgcggctccaagtacggcgtcggcggccacatcgccaccttcgcctccgccgcgtggctctacgagaccggcttccagcacttcttccgcgggaaggaggccgacggatcgggcgaccagctctacatccagggccacgcctcccccggcatctacgcccgcgccttcctcgacgggcgcatctccgagcagcagctcgacaacttccgccaggagtccggcggcaacggcctgccgtcctacccgcacccgcggcgcctgccgtggctgtgggagttcccgacggtctccatgggcctcggcccgctgtccgcgatctaccaggcgcggttcaaccgctacctgcagaaccgcagcatcaaggacaccgcgaactcgcacgtctgggccttcctgggcgacggcgagatggacgagcccgagtcgaccgccgccctggccctcgcctcccgcgagcagctcgacaacctgaccttcgtcatcaactgcaacctgcagcgcctcgacggtccggtccgcgccaacttccgcgtggtccaggagctggaggcccagttccgcggcgccggctggaacgtcatcaagtcgctgtggggatccgcctgggacgagctgttccagctcgacgcctcgggcgccctcgtacgccgcctgcgcgaggtaccggacgcgcagttccagacgtacgcgacccgtgacgtggcctacatccgccagcacttcttcggcgccaacgccgagctcgtgcagctggccggggtgctctccgacgccaagatcgccgagtgcttccacagctcccgcggcggccacgagccccgcaaggtctacgccgcgtacaaggccgccctggagcacaagggcgcgccgacggtcatcctcgcgcagaccgtcaagggctacacgctgggtgccgggttcgagtcgaagaacgcgaaccaccagatgaagaagctgacgatcgacgagttcaaggacatgcgtgacctccttggcctcccgatcccggacagcgccttcgccgacggccaggtcccgtacggccacccgggcgcgaacagccccgaggtccagtacctgaacgagcgccgcgcggccctcggcggcccggccccggcccgcaaggtcaagcacgtggccctgccggctccggccgaccgctccttcgccccgctgctcaagggttccggcaagcaggagatggccaccaccatggccttcgtccggctcgtcaaggacctgatgcgagacaaggagaccggcaagcgctgggttccgatcgtccccgacgaggcccgtaccttcggtatggagtccctcttcccgtcggccggcatctactcgccgctgggccagacgtacgagccggtcgaccgcgaccagctcatgtactacaaggaagccaaggacggccagatcctcaacgaggggatcaccgaggccggcgccatggccgacttcatcgccgcctgcacgtcgtacgcgacgcacggcgagccgatgatcccgttctacatcttctactcgatgttcggctggcagcgcaccgccgaccagatgtggcagctcgccgaccagctcggcaagggcttcatcgtcggtgccaccgccggccgcaccaccctgaccggtgagggcctgcagcacgcggacggccactcgcacctgatcgcgtccacgaacccggcgtcgctcaactacgacccggccttcgcgtacgagatcgcggtgatcgtcaagaacggtctgcgccggatgtacggcgagacgccggaagacgtcttctactacctgacggtctacaacgagccgaaggtccagcccgccatgccggagggcgtggaggagggcatcctcaagggtctctaccgcttcaacacggcggcggacctggcggaggcggccccggccgccgacgcccccaaggtccagctgatggcctcgggtacggcgatccactggatcctggaggcgcagaagctgctggccgccgagtggaacgtggccgccgacgtctggtccgccacctcctggggtgagctgcggcgcgacgcgctggagtgcgacgaggcgctgctgcgcggcgaggtccgcaccccgttcgtcacccgcgcgctggaaggcgcccagggtccggtgctcgccgtctccgactggatgcgtcaggtcccggaccagatcagccagtgggtggagcaggactacacctcgctcggcacggacggcttcggtctgtccgacacccgcgagggcgcccgccgccacttcggtgtcgacgcccagtcgatcgtggtggccgcgctggcccagctcgcccgccgcggcgaggtgccggcgtcctccgtcaaggaggcccgggagcgctacggcctgtaaggccgcgcgcccgcgcacgacacaccgaaggccggtgtccgacccccgtgacgggggcggacaccggcctttggccgtatgcgcggtggcggcgagcaggccgacccgtgatgctggagcggtgatggacgagacggagttctgggagatcgtcgaccgtacccgcgaggccgccgacggcgaccccgaggagcatgccgaactgctcgtggagcggctcgcacagttcgacccggactctgtcctggacttcgcccggcacttcgagtcccggtacaaccgggcgtacacgtgggacctgtggggcgcggcctgggtgctgctcgacggggcgagcgacgacgccttcgactacttccgctgctggctgatcggccaggggcgggaggtgttcgagggcgcagtgcacgatcccgaccacctggcggagctcctgggcgacttcgacgaggagatcgacggggacggcgaggagctggggtacgcggccgacgaggcgtacgagcagctgaccggggcggtcgcgccggatctgggcatcccgctgcaggcggcggagccggagggcgccccgctggacttcgagaacgaagccgtgctcgcggagcgctttccccggctgtgggaccggttccgcagctgatcagcagtgcgtgccgccgtcgatgcggatctccgtaccggtgatgaacgcgccgtcgtcggagcccagcatggcgacgacgccggcgacggtctccgggccggcgaagccctggccgagggcgggggccagcttggcgaagagggaccagtcggtgtcctcgggcagcccggggccgttgccggtggtcatgccgctctcgatggagccgggcgcgacgctgacgaagcgcaggccctgcttgctgtactcggcggccagcgcgtgggtcatggactggatgccgcccttgctggccgcgtaggcggacatgtaggggtgggcgaaggacgccgaggtggagctgaagttcacgacgaccggcctgtcgcccgagagcagcgccgggagggactcgcggatcatcaggaaggtgccggtcaggttgaccccgatgacctggttccagaggtcgagggtggtctggtgggtgtgcgcggagcgcaggatgccggccgcgttgaccagcacgtcgatgccgctcccgccgaggacgccggccgcggccgccacgccctccttgacggcgttctcgtcggatatgtcgaggggcgccgtggtgagccgggccgcgtggccgtcggcggcggcccggtcggcggtcgccttcaggcccgcctcgtcgacgtccacggtgtggacccggccgccctcggcgaggatgcggtggacggtggcgcggccgatgccggagccgccgccggtgatgaggacgcgacgtccttcgtaacggttcatggcgcgagcgtaccgagcagtggcacgttttgccatgatgacaaggaacgcaatcatcgaggtcggtgaggggtacgcttcacccgtgagatcccctcgtccgtacgctccccagcccggccccggagcccagtcgctgaccgagcgccgcaaggccgccacccagctggacatcgcccgcgcggcctgcgaactcttcgccgaacacggccccgacgggaccaccgccgaggacatcgcccaccgggcgggcgtggccctgcgcaccttctaccgctacttccgcaacaagcaggaggcggtggccccgctgctggcgggcggcggtgacgcctggcgcgccctgctcgccgaggaggaccccggcacaccgctgggcgaggcgctggaacgcgccgtcacccggtcgctgagcggacaacaggcggtggaggagggcctggaggtgacccgcggcctgctgcgggcggccgcggacgaccaggccctgcgcgcggtctggtaccgcgtgaaccaggactcggaggagcatctggtcccggtgatctcccggctggcgggcccggaggccgacccgctggaggtgcgcctgctcgcggcggcggccacggacgcgatccgtgtctcgctggagctgtggtcgacgacggacgccccggtctcgggccccggatccccgccggagctcgcggtccgctgtctgcgcgacctcacaggggcgatgcccctgctcctcggctgaggtccggagcaggggcatcggaggatcgggcccgcggccctatgtttccgggtggggctcagcgaccaccccagccgccgccgccgtcaccaccgccgccgccccagttgccgccgccgtcgccaccgcgaccgccgccgtcaccccagttgccgccgccgttgccgccgtcaccgccacggccgttgccccagtcaccgttgccgccgcgaccgttgccccagtcgtcgtggttgccccagtcaccgttgccaccgcggcccgagtcgttccagttcgaccagttcgagtcgcgccagttgctgtcgcgccagttgttgtcgcgccagttgtcgttgtatccgccgacgccgccctggtcccagcaccagctgggccggttgcgccagtcgtggttgcagcaggcgtcccatcgggcgtcggagcggttcgaggggtaccggtagcagtcgtagccaccgttaccgccgactccgccaccaccaccggtgacgaccgaggccgaggcgctggcgacgggcagcagacctatcgcgattcccgcggcgcccgccatggctgccgcaacgatcttacggcgcattctcatgcacctccgcacatgtctcgcttatagcgcttttaggtcatttccaccctcactcggacatgcggacctgtcaaagcggaaaggccccccgccgcgctccgtagagcgtggcggggggcctcccagcaggcgtttttagatgtcgaagtacagctcgaactcgtgcgggtgcggacgctgcgcgatcggggcgatctcgtgcgtgcgcttgtagtcgatccaggtctcgatcaggtcgggggtgaagacaccgccggccaggaggtactcgtggtccgcctccagggccttgaggacgtcctcgaggctggtcgggacctgcgggacgctcgcgtgctcgtcgggcgagagctcgtagaggtccttgtcgatcggctccatcggctcgatcttgttcttgacaccgtcgaggcccgcgagcagcagcgccgcgaaggcgaggtacgggttggacgacgggtccggggcgcggaactcgacgcgcttggccttcgggttcgagcccgtgatcgggatgcgcatggcggcggagcggttgcgctgcgagtacaccatgttgaccggcgcctcgaagcccggcaccaggcggtggtaggagttcaccgtcgggttggtgaacgccagcagcgacggcgcgtgcttgaggatgccgccgatgtagtagcgcgcggtgtccgacaggcccgcgtagccggcctcgtcgtagaacagcgggtcgccgttcgcccacagcgactggtgcacgtgcatgcccgagccgttgtcaccgaagatcggcttcggcatgaaggtcgcggtcttaccgttgcgccaggcgacgttcttcacgatgtacttgaagagcatcaggtcgtcggccgcggcgagcagcgtgttgaacttgtagttgatctcggcctggccaccggtgccgacctcgtggtgctggcgctcgacctggaggccctgggcgtccagttcgagggagatctcggcgcgcaggtcggcgaagtggtcgaccggggctacggggaagtaaccacccttgtagcggaccttgtaaccacggttgttctcctcggagccggtgttccaggcgccggcctcggagtcgatgtggtagaagccctcgttcgcggaggtcgcgaagcgcacgctgtcgaacacgtagaactcggcctcggggccgaagtacgcggtgtcggcgatgccggtggaggcgaggtacgcctcggccttcttcgcgatgttgcgcgggtcgcggctgtaggcctcacccgtgatcgggtcgtggatgaagaagttgatgttgagcgtcttgtccttgcggaacgggtccagacgcgcggtggtgatgtcggcacgcagcgccatgtcggactcgtggatcgcctggaaaccgcggatcgaggatccgtcgaaggcgagctcctccgccgggtcgaacgctcgcgccgggatggtgaagtgctgcatcacaccaggcaggtcacagaagcggacgtcgacgaacttgacgtcgttctcctcgatgtactgcttcacttcgtcggcgttcttgaacatccaactcctcctactcccggccccggggcagggacgggctttatagctcgtggtgcgtcagtgcggtgccgcacgctgacccgaccataagcagacgggatttcccaagcatgacccatttgtttcgcacaagttaaccagggtccggccggagggccgtgcggcgccacgggtaccgtgttcgggtggacaacagacaggcaatcggatcctggctctccggcccccgcgcggccgccgaggagatgggcgtcgacttcggctatccgggtcagcgactcggcctcccccagcaggggcccggctcggtggcccggttcgggcgccggctcggcgccgtcgcgatcgactggatcggctgccagctgattgcctacgggctgatcacgcgcggcgacatggcctcggccggcaactggaccctcgcgctcttcgtgaccctcaccatcctgacggtcggcaccgtgggcttcacccccggcaagcggatcctgggcctccgggtgatttcggagtccggcggccgcctcggcatcgtccgggtggtcctgcggacgctgctgctggccctggtcatcccggcgctgatctgggaccgcgacggccgcggcctgcacgaccggctggcacgcgccgtccaggtccgcatctagtccgcatccggtccgcagcggaagccgtacgacacaggggtgccccccgagctcacgggctcggggggcacccctgtgtcgtatacgaaaatcagctgaccgggtcagcgcatctttccgccgcgcggcatcttcatgcccttcggcatggggcccttcggcagcggcatgttgctcatgagatcacccatggcgcgcagcttgtcgttgacctcggtgatctgcgggccggccagcacgcgcggcagcttgagcagggtggtgcgcaccttcttgagcggcacctcgccctcgcccgtgcccacgatgaagtcgtgcaccggcacgtccggcatgatccgggccagcttcttcttctcgttcgcgagcagcggcttcacgcggttcgggttgccctcggcgatcagcacgacgccggccttgccgacggcacggtggacgatgtcctgctgccgggtcatcgcgatggccggggtggtcgtccagccccgtcccacgttgtccagaacggccgcggccgctcccggctggccctccatctgcccgaaggcagcgcgctcggcccgccgtccgaagacgatcgccatcgcgaggaacgccaccaggaatcccaggacgcccaggtagatctcgtgctcgatcaggaagccgaaggcgagaaagacaccgaaggtgacgatgcccacgcccgcgacgatcagaccgaccttcgggtccgccttgcgcgtcatcttgtacgtgagggcgatctgcttcagtcgcccggggttcgcagcagtctctgcgtttgacttcctcgccataaagcgaagtttacgtggcctgcggggttcgggtagccgcggcctcaagtacgtgttcggtttcgacccggtccttggccctcttgcggtcctccaggaccgccgtccaggcgttgcggcgggccccgctcatcagcagggactcgatgccccggaaggcatcggagaaggtcgggatggcaatggcgcgtacgggcgcggcctgcatggtgtcgatccctttcacgatgctcgcgtcggcgtgatgcgagcggtgtgtgcggtgcgtggaccaagcgtcactgactggtgttaccagggcgtgaccggtcggtcaaatgtgatggacacgttgcaaacactgacgcggcccgccggactcttcctctgggaagagcctaggggccgcgtcggcgcggtgttacccgctagtaacgctttgtgcgcgacttcacacgctcgcgcgcttctctgtacccgcggtcgagctccgcctcgtcaccgctccggccgagtgcccgccctcgtacctcgggcggaccctcgacctgcgctcagactcggctgcgcttctccatcgcctgctggtagaggcgacccgcccggtaggacgagcggaccagcggaccggacatgacgccggagtagccgatctcctcggcctccttcgccagctccacgaactcggccggcttcacccagcgctcgacggggtggtgccgcggcgagggccgcaggtactgggtgatggtgatgagctcacagccggcctcgtgcaggtccttcagggcctgcgagacctcctcgcgctcctcgcccatgccgaggatcaggttcgacttggtcaccaggccgtaggcgcgggctttggtgatcacgtcgagcgagcgctcgtagcggaagccggggcggatccgcttgaagatccgcggcaccgtctcgacgttgtgcgcgaagacctcggggcgggaggcgaagacctcctccagcagctccgggaccgcgttgaagtcgggggccagcagctcgaccttggtgtggccggtctcgcggcccgccgtctgctggtggatctggcgcacggtctccgcgtacagccaggcgccgccgtcggccaggtcgtcgcgcgcgacgcccgtgatggtggcgtagttgaggtccatcgtgaccacggactcgccgacgcgccgcggctcgtcacggtccagcgcctcgggcttgcccgtgtcgatctggcagaagtcacagcgccgggtgcactggtcaccaccgatgaggaaggtggcctcgcggtcctcccagcattcgtagatgttcggacagccggcttcctggcacaccgtgtgcagtccttcgcccttcaccagggcctgcatcttggtgtactcgggacccatcttcgcccgggtcttgatccactcgggcttgcgctcgatgggggtctgggcgttacggacctccaggcgcagcatcttgcgtccgtcgggtgcgactgcggacacgaccggctccctgtgacttcgattgttcgggcgcccaccagggtacgcccgtaatttcgtacgctcttacgtcggccaacctgcgaggggccggccgcattcccggggcgtcaggcgcccgcggccgacgccgtttcacggggcttcggctcggcgtgctccagcacgtccctcaggtgccgttcggccaccgggagtacctccgcgatggtgacctcgcggcccagttcgtacgagagcgaggtcacaccggcgtcccggatcccgcaggggatgatccggtcgaaccaggtgctgtccgggttcacgttgatcgcgaagccgtgcatcgtgacgcccttggcgacccggatgccgatggcggcgagcttgcggtcctcgcggcgctggcccgcgttggacggggcgtactcggggccgttcagccgcgcgtcgaactcctcgtcgtgcagccgggggtcgaactccagcgagaggccgccgatcttcgggcgctcctcgacggggtcgcccaggacccagacgccggagcggccctcgacccgggtggtctccaggccgaactcggcggcggtgcggatcagggcctcttcgaggcggcggacgtgggcgaccacgtccaccgggcggggcagcttcatgatcgggtagccgaccagctggcccgggccgtgccaggtgatcttgccgccgcggtccacgtcgacgacgggggtgccgtcgagcgggcgctcgctgggatcggtacgccggccggccgtgtagaccggcaggtgctccagcaggaggcaggtgtcctctatctcgtccgcgaagcgggccgcgtgcaccctgcgctgttcttcccaggcccgggtgtactcgacggattccggtccgaagcccagatggacaaacccaagctcagccaccgcagcgcctcctcgttgaacctgctgtgtgcacgtacctcactgagcaagggtacggcgggccgtgcgggccccttcagggccccggcgcgggctcgggggcgggctcatgcgcgggttcccgcgcgggttccgccgggggtcccggcagctgcttcggccggcgccgtcccctggacggccggtccgggtcctcgtccgcgcgcggcagccgccggtggccctccgagtggtcgttgacccagccgcacaccccgcacgcgtaccggccgtcgagccccgcgatgtaggtgccgcagcgccggcactccgcctcggtcagttcgggcgggggcagcggggcggtggattcggttcgctcctcggggaggtgcgccctggggggccgaggggtcatggcccgcagcgtacgcgggcggagggggccggtccgtaaagggccctacgcattctgcacacgatcggatgaatgtggggcagagagggcagcatcagcgaagttcgccgctacattcacgccgttcacagggccgggaccccggtccgtcacgtcaggaaaccgtggagccgatgacggaacgacctgcccagcgtgtccccaaccggcagctcgcggcgctgatcgcggaagccgggttctccaacgccgggctagcccgccgcgtcgaccagctcggtctggagcacggtctcgacctgcgctacgacaagacctcggtgacccggtggctgcgcgggcagcagccccgcggcaccaccccggcactgatcgccgaggtcttcacccgccgcctcggccgacggctctccgcccaggacctcggcctggacgcctgcgcgcccgtgtacgcggggctggagttcgcggccacccccgaggaagccgtcgacatcgcgagcgggctgtggcgcaaggactccggctcgcacgccgagctccggaagatcgccttcaccccggccgggctggtcgtgcccagccgggactggctgatcgggcgcgccgacgagcgggtcggccggggcgcggagccctcggcggcccgcgtcccgctgcagggacgggcctcggtaccccggcagcggcagatcgaccgcggccccgggcagcgcgtgaccagcggggacatcgccgcactgagatcggtgagcgagctgttccggaccctggaccaggcctacggcggcgggcacgcccgccaggccctggtccgctacctggagcacgaggccgagcccatgctccgcgggacctacggggagaccaccgggcggcggctcttctcggccgccgccgatctgacccggctcgcgggctggacctcctacgacatcgccgcgcacgggctcgcccagcggtacttcgtacaggcgctgcggctcgcgcaggcggccgcggaccggccctacggctcgtacgtcctggtcaccatgagccggcaggcggtctacctcggccacggccgcgaggccgtccagctggcccgggtggcccagcagggcgtcggttccggcccgccgccggtggtgcaggcgctgctccactcggcggaggcgcgtggtcacgccgtcctcggcgaggtccgcgcgtcgaccgcgtccctggtgcgggccgagcgggcgctgggcgcggcccgtccgggggacgacgtaccgcactgggcgcgcgccttcgacgaggcgcagctggcggacgagttcgggcactgccaccgggacctccagcagtaccgggcctcggcccagcacgcggagcggtccctgcagctgagggcgccggggtacgcgcggtcccggctgttctgccgggtggtgctggccacggcccggctggggctgggcgagctggaccaggcgtgcgcgctgggcgcggaggcggcgcagcaggcgatggagatgcggtcggtgcgggcggtggagtacgtacgggacttcgagcggcggctggagccctaccgggacgcctcggccgtgcggacctaccgggaccgggtggcggccctgtcctgacggcgccggcccggcggccggccgacggcaggggcccggtcccctggcgggaggaccgggaccctgtggcgtcggtggttctcaggccgccaccggaagtgcgggttccggtgccaccgggatggggatgccgaagtcgcgcaggacggctccggcggcacggcgggccgagtgcagggctccctggacggtgttggtgtcgcggtggtcaccgcacacgtacagcccggccagcacccgtacgggacgccgcaggtcgtgcggcgggggcatcgcgggaaccgcctccggggtgtggtggacggtcagcagctcccactcgcgagtgggggtgtcgtagagccgggccaggcgcgaggcgaccgtacgcacgggcggcggcggcccgaggacggtggtggtgaccaggctccggccggccggggcccgcgtcgggtcgaccgcgctcatcacggccgtgtgggagacgggccacctggggtccccgtccaggagcagcgagccgtcccggaacaggggtgcgctggtggcgtggtgcaggacggtgacctcgtggaaggccggcacgcgcaggccgggcaggagctcggcggcggcgcgggcgccggtggccaggagcacggaccggcagcggaagtcgccgtgctcctcggtggtgaccaggttggtcgccaccgaccggacccgtacgccggtccgtacggtgccgggtggcagggcggcggcgagcaggtcgggcagggccgccgcgccgccctcgggcacggcgaggcggccgcgggcgaaggtgcgcagggcgaggtcggcgacccggctggaggtggtgagttccgggtcgcgcagcagggtggcgagcagggggcggagcgccccgttcagggtgcgcgtgggcagcccccgggagcgcagggcggcgtgtgcggtgcgttcgggtcgggcgagcagcttctcctcgggcagggtggcgagccgggccagggcggcgctgatccgggcctggtcgagggagccgctggccagggcccgggccggggtgaggaccccgacccgcagcggtttcccgtcggtgtggacgaggacgcccggcgcgaaggggcgcagggtcagggcccgcaggccgggggtgcgttcgagctccgtgtacgcggtgttgagcagttggccgatccggtcgagccggaatccgtcggcggactcggtggccatccgcccgccggggtcgtccgcggcctccaggacggtgaccgtgactccggctgcgatcaggtgctgcgctgccgcgagtcctgagactccggctcctacgatgacgacgtccgcatggtgtgcggcctggtgtgcgctgctgagcacgtgcccctccccgaggtcggcgcggctgtgtggggatcctccttcccccaacgggttaaaggggaacccgagttcgcccgggtattgcggtcaactccggtcgcacagcggtcgcatatgggtcacgaacggtcgcacggtggtcgcacgcggatctcagagcgcggcgcggatcgcctgctcgatgccggggtcgcgaaagacgaatccggactccagcagccgcgcgggccgggcccgctgactgcccagcacgtccccggagaactcccccagcaccacgcgcagcgccacggccggcacgggcagcagcgcgggccggtgcagcacccgggccatggcctcggtgacctggcggttggtcagcggctccggggcggtcaggttgaccgggccggacacgcccggggtgtcgatgacgtgccgcagggccgcgacctcgtcccggagggagatgtacgaccagtactggcggccgttgccgagccggccgccgacaccggcccggaagatcgggaacatccgcccccaggccccgccctcgcgggcgacgaccagaccggtacgggcgaacgcggtccggatcccggcctcctgggcgggggcggcggccgcctcccactccacgcagaccgagggcaggaacccctgcccggcgggggcgccctcgtcgacggcccggtcgccggtgtccccgtagtagccgacggccgaaccgctgaccaggacggcgggcggctcgtcgagcgcggcgagggcgttcgcgagcgcggccgtgccgagcacccggctgtcacggatctccctcttgtacgcggccgtccaccggtggtccccgaccccggccccggccagatgcacgacggccccgcagccggccagcccggcggggtccacgaacccccgtgccggatcccaccgcgcctcgtccgccccgacgggctcccggcgtacgaaccgcaccacctcgtgcccgtccgcccgcagggaccgcacgagtgcacttccgatgagcccggtcgacccggtgacagcaatcctcatgcccccatcctgccggtcggccgcacgcccggcggtgtccgcgcgcggcgggccgtcgttatcggttcgtccggcacgtcgagcagcgagggtgtgaggcatggggcgcaggaagcctggcaagcagcggcgtccacgggaccggcgcggggccgcggagtaccccctgcgcgagccggcgccaccgggtcctatccaccgggaccgggaccgggtcctggacaccgggaggccgccggtcctgggggagcggacggcggcggctccccggacgtgccggccggacctgatgctgcacgacctcccgctgcaggccgcgatggcggtcgtctacgtgcggtgctgccggggccggcgggaggaacccgacttcgaggagttcgcggcacgccaccacgacggggacgcggaggcggcccgatccgcgtgggacctggcctggtcctcgggtcacatcgagcagcggggttgcgaggcgtgcccggccgggcacctgtgcacccgcacctgaggccgcccgggcgcggcgcggaagccgggcccggcgcggaagccgggcccggccccgctcaggcggtggtgccgagccaggtgcccaccgcgtaggtgacgcccatcgcgagcgcgccgcccgcgacgttccgcagcaccgcccgccccatcggcgccccgcccagccgggcgctgatcaccccgcacagcgtcagcgccgccagcaccgccgccaccgtcaccggcacacgcgccgaaggccccggcaggatgatcgccagcagcggcagcagcgcccccaccgtgaaggcgacgagactggcgaaggccgcgtgccacggattggccagctcgtcgggattgatcccgagctccacccgggcatgggcccgcagcgcgtcccgctccgtcagctgctcggcggcctcccgcgccacgtcccggctgagtccccgctcggcgagcaggtcggtgagctcgtcgagctccgcctccggctcctgggccagctcccagcgctccaggtcgagcgcggcccgctcggagtcccgctgggagctcacggagacgtactcccccgccgccatcgacagcgagcccgccagcagcccggcgacgcccgccgccaggatcgccgagcgcgaggtggtggcccccgccacaccgaccaccaggcccgcggtggagatgatcccgtcgttggccccgagcacacccgcgcgcagccagttgagccgcgtgctgatctccgcgctctgcgagccgtcgccctcgccgtgcgcctcgatgtgcgccttgccaggccgcttccccgcgccttcgcctgccgtcacgcccccactgtcgcggcccggggcccacggggccacccggcgggccggtccggggtgcgcgcacccggcccccgtaccagggtggaggggtgagacgccgacgcgaggagccgggcgggctgcgcggggaaccgccgccacgctgggcccggatcgcacccgcggcggccctggtggcgctggtcctcgcccaggcgctgaccccgggcgcggagctcgggttcttcctggcgggcctgcccccggtggccgccttcgcgtacggggcggccgggaccgcggccttcgccgccatcgtcctgctgctcctgggcctgccgtccctcggcgtgggccacgcccgcagtacggacctggccacggtggccgccgtctgcgtgctcagcgtggtgatcgcctgggtccgccagcgccgggacgcgcagctggtcagcgtgcggacggtcgcggaggcggcccagctcgcggtcctcccgccggtaccggaccgggtgggcccggtgcgctgctcgggcctgtaccgggcggcgcagcgcggcacgctggtcggcggcgacctgtacgacgtacgggccgggccgtacggggtacgggcgctggtcggcgacgtacagggacacggcctggcggcggtctccacggtgggggcgctgctcggcgccttccgcgaggccgtgatcgacgacgccgggctcgcggcggtcgccgcccggctggaccggcggctggtggcggacgcggcggccacctcggtcgagcatccggagctgttcgccacggccgtgctgctggagttcccgccggggctggacgtcgtacggatcgtgtcgtgcgggcatccgtcggccctgcgcgtgcgcggatcggtggtggacgagctgaccgtggagccgggaccgcccctcggcctggggctcgccggcccgaccccgccggtggtgacggaactggcggtgcgtcccggggaccagctgctgctgcacaccgacggcgtgacggaggcccgcgacgcggcggggcagttctacccgctggccgcccgggtgcccgtactgacacgggaccccgagggtctggtgggggcggtgtggcgggacctcgcggctttcacgaagggcggtccgaacgacgacgtggccctgctgctgctgtccctggacgggcgggacccggcggcgcgggcagcgccgtgagggggtcctcgccgtggtggacggtgtgcgtgagcgcgtgctcgtaggcgggccgggggaagacgaacggcccgagggcgagatcgccccagacctgccgacggggctggcggaaggcggcccaggtgacggtcccggggtggcggtgatgcgggcgaacaggggccagcactcccacatgccgcaggggcaccccagcaccggagtcgcgtccgtctgaatgtcccggacgtccggggcggcgtcgccgaggaagtggcgcaccgggtcaccgaggacgtgctccgccatcccggcgtactgcttgagcaggaagtcctccgtgtcctgcggcgtcctctcgtaggcgctcttctcccgcagccacagaggacgggtggcatccgcggcatggacccgcagatcggccccgtcgacgcggacgccccacaggcgctcggacgtgtaggtgaagaactcgatgtgctgcatggagatcatcttgcgggagccccgccggaatcccgggcccggggggaccgctggtccggtcccggccggccgcgctcggccggccgggacccctgtcgtacggtcagtgccgagccgtggcgaacacgaccgacgcctgacgcctgacgcctacgactccatgatgaacgcgcgcaccatcttgcaggtgacattcgacggccggtggatccccgtccggacagccatcgtccgaatcttccggttggtggcacgccgagcgtcgtaggtccccgagtcgagcagggatatcgccagccgcatcgccttcagacggcggttgtggctctcgtaccactcgcggggcaaccccgccggcagcggcttcttcttgacgtgctggacggtggtggcagtggccatctacagcctcccaaacggtagttggcttcctgtcgttcttcctcgattttaccggggaccactgacagaagcccctggccagaccggccctgggtagggtgccgccatggagatctggatcaatccggcctgttccaagtgccgcagcgccctgaccctgctggacgcggagggcgccgagtacacggtgcgccgctacctggaggacgtgccctccgaggacgagatccgcgaggtgctcgggcgcctcgggctggagccgtgggacatcacgcgcaccgcggaccccctcgccaaggagaccggggtacgggacctgccgcgcgaggagaccgacgcggcgcgcgggctctggatcgcccacctggccgcccacccgaagctcatccagcgcccgatcatcaccgccgaggacggcacggccgtggtgggccgctccgaggaggccgtccgcgaggccctgtcccgcaagggctagaagacgcgccggacgatctccgcggcggccgtcagcggcagcgcgtggtgcgacaccccgggcaggacgccgacccgcgcgcccggcagcgcctcgcgtgcggcccgggccgcacggccggagtcgtggcagcgggcgagcgcggcgaactggatgtcgatccgcgggcccgtgcccgccggtcgcgcgagcccggccaggtccgggcgcggcccggtgaccggccgcacggcgggaaagccggcgctctcctcctgcagccgcagccaggccggatcgagcgcggccccgcgggtctcccaggcgaggaaggagcggatccgctccggcgcgggccgcaccagcatcggcagcgcgcgcagtacgtaccccgggcgcagccccgcgaagacctgagtcgggtcgagcagcaccaggcggccgagccgggccgggcgccgggcggcgtagtgggcggcgatccaggccccgtacgagtgcccggcgagggtcaccggtccgcccgggcccagcccgtcgaggaccgcgtcgagccagccgaccaggtccccgacggccctgatcgcgcggccgggcgccgcagcgctgagcccggggtctcccaccaggtccacggcgtgcacccggtgggcgcgcgcggccccctccgcgacgcacgccccccacacggtggaggtggcccctccgccgggcagcagcaccagcggaggcgcgccggccgggccgcaggtgttgacgcgggtttccccgtacggggtgggcaggtcgacggcctcgacggggccgggccaccggtcgagcaccgcgccgtaggcggcgcggaaggaagacgtcccgggcatgtccactcccctccctcatccagcatctcggcaggcaataatctcgctcagcgagagattctgtcagggggcgatgtgaacgacaacgaggaaccggtgaacgcgcgcgaagaaggggaaccggacaaccttcgactggtgcacctgctgcgcgcggtgaccgtcgagttcggcctgcgccaggcggacttcgccgcccgcaacggcatgcaccccaccgacgtacgcgccctgatctgcctgctggacgcggcccgcgccggcgaaccggccaccgcgggcctgctcggcgcccgcctcggcctcaactccgcgggcaccaccgccgtgatcgaccgcctcgaagggctcggtcacgtggcacgcgtccgcgacgaccgcgaccgccgccggatcctgctgcgcgtggagccggcggccatccgtctgggccgggagttcttcggccccctgatcgacgggatgctccaggtgctcgactccttcgatcctgccgaacgggagaccgtacgccgcttcctgacggccacccacaccgtcttcgccccggagccgcgcccatgaccacccccggcccgggccccggcggcgccgacctgcacctggaactccccgccgagggggcccggcggaccgtcctcgcccaagccctgcgcagcgccgtacgcagcggccgactggccggcgggaccctgctgccgccgtaccggacactggccgccgacctcgggctggcccgcaacgccgtcgccgacgcgtacgccgagctggtcgccgagggctggttcaccgcccgtcagggctccggcacccgggtcgccgagggagtcgcgaccaacggtgcgccgacccccgccgccggagccgcacccgaccggccccgccacgacctgctccagggcaagcccgaccccgcctccttcccgcggggcgcctgggccaccagcgcccgccgagccctggccgaggcacccaccgaggccttcgggcccggcgatccgcagggccgccccgaactgcggcgcgccctggccggctacctctcccgggcgcggggcgtgcgctgcggccccgagaacatcgtgatctgctccggcttcgccaacggactgcggctcctggcctccgtccggccccgcgactgggccgtcgaggcgtacggactccccttccaccacggcatcctccagaccgccggggtccgcgcacaccccgtcgcggtcgacgaggacggcgcccggacggcggaactccccgccccggcccgtacgttactgctcacaccggcgcaccagttcccgaccggcggccgcctgctgcccgcacggcgggccgccgccgtggaatgggcccgcggctccggcggagtcatcgtggaggacgactacgacggggagttccgctacgaccgcaaacccgtcggcgcactgcagggactggcccccgaacacgtggtgtacgcgggctcgctgagcaagagcctctcccccgcgctgcgcctgggctggctggtcctccccgaccagctgcgcgaccgggtcctggccgcgaaggggctgcgggaatcctgggcgagcgcgctggaccagctggcgctcgccgacttcgtcgagtgcggggcgtacgaccgccacgtacgccggatgcgcctgcgctaccgggaccgccgcgaccggctggtcgccctactggcgtcccgcgccccggaggtccgggtgacgggcatctcggccgggctgcacgccgtactggaactccccccggggcgggaatcccccaccctcgcggcggcccgcgccgcgggcctggcactggacggcctctcgtcctaccgacacccgtccgacccggccccaccccgcgagggcctggtgatcggctacgcatcacccccggacacagccttcacccgagccctcgaagccttggcgggggtggcgggcgaggccggctagcggggcggtggctccggacggcggaaaccggcggaccgggccagggaaggcgcgggcggctctggggagcgggggccggccgaccggggccgggaaggcgcgggcggctctagggagccggaagccagccgaccggggccggaaaagtgcgggcggctctagggagcggaagccgaccgatcggagtcgggaaccgagcggcggccctggagggcgggagccgctcgggcggtggtcagggatgtgtatgggggtttcccgtcagtctcatcgtctctccgtgtcgggacggtccctcaagggcgctcgttcctcgcgtcgcttcgcgatggccttgcggccacccttgaccgaccgtcccgccacggaaatccgaagactgccgagaagcccccaaaagaacgagccgggcactcaaggatcaggacggggcggccagagaccccctgccttgtcgggggtggggacgaccgacagacggggcccatccatacccccgcccggaccggggggaagcgcgaccaatcgctacgcgctcctcacgtctcagcgtctccagtccgtcctgggctggacataggccgcccaagggccccgatccgacactcgacctgcgaccgacgaccgtccggggccggacataggccgcccacggccccggtcccccatcgacgcgcgtccgacggccgtccgggactgggcgtaagccgcccaccacccattcgcttctcccagactgcgaccgacggccggtttggtgctgacgagagccgccgagagggactgacagccgaaacctcgcctattccgtcgtggaaccgggtcagtgagaccacgacaccacaaacccacccccaaacaagggcaattggggcgaactggcggccttctgggccactcatgtgcgctgacctgcatccacgacgaaatagccgcagttccacgtcttttcaccccggacgacggccagacgcagccaaagaggaccctcatgcgcctgggcgggcgcgccgaccgtccgccgccgacagcgagaagcgcgtggatggtgagcgacttacgcccggccccggacggtcgtcggacgcatgtcgagcgtgggatcggggcccttgggcggcctatgtccagcccaagacggggtggagacgctgagacgtgaggagcgcgtagcgatttggcgcgcttccccggtccgggtccgggtctggatgggccccgcctctcggccgtccccacccccgacaaggcagggggtctctggccgccccgtccttcaaagcctggaccggctcgttcctttgggggcttctcggcagtcttcggatttccggggcgggacggtcggtcaagggtggcgaaggccatcgcgaagcgacgcgacgaaggagcgcccttgagggaccggcccgacacggagagacgatgagactgacgggaaacccccatacacatcaccgaccaccgccccagcggctcccgcacaccgaagccaccgccacaggtcccgaccccgcccgcccagcccccgcacaccgcagcccccgccccgcctcccgacccccgcccgagcggctcccgccctccgacgccaccgccgcacccatccgtcccggccgccgggcttccgcacaccggagcgccgctcaaggggccccgcccccggccagcggcccccgcgctctcttcacctcgcccccaccttccaccccctagggtgacccgaggagcaaagaggacgtatcgcaccaaaggacccgttgtgaaccaggagcagcaagcacaccgccccgcgggacggggcgggcggcggggggccgactggatgttcggcggggtgtacgggaccgttctggccagtgcgctgttggccgcgctgcatcagaagggcgaggagttcaccccgttctacgacgccagctgggtgctcgtgacggccgcgaccgccgggctcgcgcacgggtactcgcaccacatggcctcccaccggcaggactccgccgggtaccggtggcggatgctcggcgtggcgctgtggaacgagtggccgctgatcgtggccgccctgcccaccgtcctgctgctggtcgccgccgggctcttcgactgggacgcctacgcggtgaccgccgtcgggctcgggctgaacaccgccctcctgttcgcctgggggacgctcgtcgcgctccgcgtgggctaccggctcgcctcggccatgccgatcggcatggccgacgccaccatcgggctggccatcatcgtggcgaacgcggtgatcaagtagggagctgcgcctccgcctcggccaggatctccgtcagccgggccccgaactccgccccgcgcggatccggcaccccggtccgggccgcggtgagcagtgcgtccagggcgcggccgtaggcgcccggtacgtcgctccagccgggcagttcgtgcactccctcggcgccgcgcagttcgagccccactccggcggccgcgcgcggcgcgcccaggctgagcacggcggtgctggctgcgccggaggcgtgccgcagtgccagctggaccacgtcggaggggccccgggtggcgctgaccgcggtgacgtcgccgaggaccgggatcagtacggacagggcgtgcgggccgacgtcccacagtccgcccttggccttgcgccagggcgagtcggcgtaggcgctgggtgttccgtcgggcgggaagaccgcgccgagccagtgggccgcggccgtgaaccagccggagcgtgcggcctgttcctcgacccagctcgcggtgggctcggcgaagcgcagggtgaggaagacgacggaggcgacctggtggcgcgcgaccgcttcggcgacggctcgggcgtcgtccacggtggtggcgacgggcttgtcgaggagcagatggcatcccgcggcggcggcgcggacggccatggcggcctggacgtcgggcggcagggcgaaggccacggcgtcacactcggcgaacagctcgtcggggtcttcgtacaccttcacgccgtactcgtgcgccagctcggccgcggcctcggggcggcggccccacacgccggcgaagtcggagccggcgtgcgcggcgagggcgggggcgtgggtgcggtgtgcccaggggccggtgcccagcagccccacccgggggcggcggcctgccggggcctgatcggtggcgccttcggcggcacgtgcggcggcgctcccggagggggcctcggtggagttcaaatcagacgaaatgctcacgcggtcagtgtgccccacccggacgggcgcgccgccaccaacccgcacaacccgcccgacctgcggtgcaaacctcggtaacacggggttcacacacgggcaacggaagagaaatcgcgggcgggcacgctgcggtcatcaccgcagcgatgaagcagcgaccagcagcacccgcagagtctgaggatggggcccgtgagctacaaggctgagtacatctggatcgacggcaccgagccgacggcgaagcttcgctccaagacgaagatcatcggggatggcgacgcgctgccgatctggggcttcgacggatcgagcacgaaccaggccgagggccacgcgtccgaccgcgtgctcaacccggtcttctcctgcccggacccgatccgcggcggcgacaacctcctcgtcctgtgcgaggtcctgaacatcgacatgaccccgcacgagtcgaacacccgcgcgctgctgcgtccggtcgccgagcggttcgccgaccaggagccgatcttcggcatcgagcaggagtacaccttcttcgacggcatccgtccgctcggcttcccggtgggcggcttcccggccgcgcagggcggctactactgcggtgtcggctcggacgagatcttcggccgcgagatcgtcgagaagcacctggaccactgcctcgccgcgggcctgagcatctccggcatcaacgccgaggtcatgcccggccagtgggagttccaggtcggtcccgtcggtccgctggaggtatcggaccagctgtggatcgcgcgctggctgctgtaccgcaccgccgaggacttcaacgtctccgcgacgctgaacccgaagccggtgaagggcgactggaacggcgcgggcgcgcacaccaacttctccacgaaggcgatgcgcgaggactaccgcgcgatcatctccgcgtgcgaggcgctgggcgagggcagcaagccgctcgaccacgtgaagaactacggcgccggcatcgacgagcgtctgacgggtctgcacgagaccgctccctggaacgagttcagctacggcgtctcggaccgcggcgcctcggtccgcatcccgtggcaggtggagaaggacggcaagggctacatcgaggaccgccgtccgaacgcgaacgtggacccgtacgtggtgacccgcctcatcacggacacctgctgcgcgggcctggagaaggacggcctggtctgacgacacgaccggtccggtgacagcgcccgccgcgcccctctgggggccggcgggcgttgtcagtggcccgtgcgacggtagggccatgttggcgatcaggatccagacggagcgcggcgagtcctacgaacgccccgcgctcggcgtgttgtcccacctcgtggagcgcatcggcgcggacggggaccacttcgtcatcgtcgagcggatcgtcgaggacccggacctctacatacaggtctggcacgacgagggcggcgactaccagttggagcaccgggacgggtccggggagcggcacttccaggcgtatctgcccacggcgggcgaggtggtcgaggtcatggcgcgctgggcccgccaggagaagggctgggacgtcgggccgggttggcagcggctccgtctcccctgagaagtttccctttgtccgggattggcaggggcatgagctcgacatgtgagatttcgatccacggtgtgagacgagacctgccccggaggcatgacttctgcttgaatggggccatggccagccattcgtacacctcgtcaggtcgcagcgacctcgagcctttctggccgtcccgtcaggatcacgattacgaccgggagtgttgccgcgcgaagaacgcgccggccctctaaagcctccgggaccctccacccgaccttccccgaggccttcggtctgcgcggtatcgacatcgacgacgtacgcacgtctcctgccgaccactccgcgtgaaagagctgaccactcatggcgaacacccgctccctctcctccgccgccaccgctgcgacctctcccctgacgtatccgcccagtccgcgccatcacctccggtccgtcgaccgggacgaggtgtcccgagtcgtggacttcctgccgccgggggccacctggctgcccgcgccccagcacaccctgccgacgctgccgggccagccgccgatgatcggctacctggtgctcgtaccggccgaccagcagcctccgatcgccttcgccccgcaggcggttgccgccgcaccgtcggcccccgccacgacccccgcccccgccccggccggcccgggtgacggccgggtccggatcgacccggcgcagcgcaccgccgaggtcgacgggcgcgtgctcgacctgacgtacctggagttcgagctcctggcccacctggtgcagcacccgcaccgggtgcacagccgggaccagctggtcaccacggtctggggctacgggcacgtcggcgacggccggaccgtggacgtccacatcgcccgcctgcgccgcaagctgggcgcctcgcaccgcgcctcgatccagacggtgcgccgggtcggctacaagtacgccccctgagcgagcggtcggcccgacgacggtcggccgacgacggtgggcccgtactcctcccgggagtacgggcccacctcgttcatgtcggtcaccggccgggcggccgggcacccggccggctgcgcggttacgcggcccgggccctgcgccccgcgacgaagcccagcaggacgtcgaccgcgaggaagacgaccaggctgatcccgagcagcgggacgaaccagccgatcacggcggtcaccgcggccagcggcagcagcgtggtcaccggaagcctgcgccaggcaccgcgcggctgggcgcggccgacggacagcttgcggtccttcgtcggccggcgcagccaccacatgcggtagccccagaagacgaggaacatcacggcgacggcgagcgcggccagcgcgatctggttggcgagcccgaaggtcgtgcccatgtgcaggtcgatgccgaagcgggtcatctgggcgaggaccgggtagtcggcgaagcgcagttcgtccatgacgcgggcgtcggcggggtcgacggcgaccgagtccaggtggaccggcaccagcttgtcctgctccttgatgacgtaccccttgcccttggcgggcagggtcacgcggagcgcctcggtgacaccggcggcccgggcggcgtccacggccttgtcgatgccgacgtcggtggtgggcgcgggcggcggggtcatctgcgtgccgtcgggcatggtgtgcccggcatgctcgccggagcccgcgtccgcaccggcgccgagctgcgcggagacggcgggggtggccccgccgaggctgtcctggagctgcccgatgttctcgccggcgtacttcgaccaggtcagtccggtggcggagaggacgacgagtccggcgacggcccacagaccgacggctccgtgccaggacagggtccggcgccggccggtggccttgcggtccgggaggaccagctgcgagcggtgcttgcggcggcggcccagccacagggcgagtccgccgagggcgaccacccacatccagctcgcggcgagctcgctgtagttccggccgaactcgccgagctggaggctggagtggaactcgctcagccaggcccgcagcggcagcgcgtcgccgacggtggcgagctgcccgcgcacctcggccgtgtacgggtcgacgaagacggtgagggtctcgccctcggggaggccggggctctccatgatcacccgggtggtggcctcggtgtcgggggcgggccatacggacacgacctcgcccgcgggggcggcacccttggccgcgtcgatctgggcgctgagcggcagggcgctctcgccgacccgggcgacggtcagctcgtcggagtagatgatcgcttcggcctgccaggaggcggcgtagagcagcccggtggcggcggcgaggaagagcagcggggcgatgagcaggcccgcgtagaagtgcatgcgcaggagcagtggccgcagggcggcccagctgccgccgcggctgccggccggcgcgaccggttcggccggttcggcgtccggggtgcggacgtcttgggactcgtcaagagacatgggaatcctaggtgttggcgaagacatggggaaccgggccccagggctcgccgccgcgccgggtcaggcgtgggcaggacgaccgggggccgtggaacgcgggaacggggcgcgtccgggcggcccgcggcgcaccacggcatgggcgtgcacggctccgcgcaggcggcgcggccgttcgtacggggcggggacgacgggcggcgccggttcggcggccacccgtgcccggaccagggcgagcgcgcgggtgagcggccgggccgcgtgcagcgcggcggtggccaggacgcgggccagccggaagacggcggcctcgccgcgcgcgagccaggcggcgcagagcagcccggcgagcacgtgggcggcgatcattccggcgccgccgtgaccggtcatgccggccatgccggtcatccccgtcatgcccgtcatgtcggccgccatgcccgcggatcccggggcgccggccatgtgggcgatgtcggccatgcccggtgcttcggcgggcatgtggtggtgcccctgcacgggagcgggagcggcgaacggcttcgtggccgcgctcctggagaagaccaggtgcagcacgccttgtacggagagcaccgcggcggtgatgcccacggggccccgtcgccgcccggcggcgagccaggcgagcccgaaggtcaacccgaaggcacccagaaggccgaacaggggaattccctctccggacatggacgaatgccccatcgcgcccagggcaacacacatggccgcgaaggtcgcggcccgcgtggcgcgcatcggcgcgaatgattcgaacatggccgggacatgttcgcacggggcgccgtcgttaccgccagaggcttatccgatcatgagcagatgaatccaattccgtggggagcggtgtacgccggcggggtccagctcggggcgtacgccctggagcgcacgggggcggccgagcgggagcggctgctccgggactgctcgacgaatgtcgacaatctcgcggccgggcgctgggagacgctcctgagcagcgctctcgtcgtcgaggagcccatgcccctgccgtacgcgctgctgctggtcgcggtgctcggatacgccgagtacgcgtacggggcctggtgggcggccgcggtgttcctgttcgggcacgccgccgcgaccctcctcgtgtacggcgccctgcgcacgacggccgaccagcggacccggagcgcgctggacgtggggaccagctacgggttcaacgccgtgctcggcgcgctgacctcggccctgccgcgcggaacggtccgtacggccgcgcgggtggggctgctggcgctcgcggcggctccggtggtccggcgcggccgcaccttcacggacgccggacacctggcggcgctcggggtgggcatcggcatctcgctcgccttcgattgcccttccgcggcgaaacatcagaaaattgcatgaacctacccatctcgcaggagccgccgcaatgaccgccatcccgtccaccaccgtcgccaacctccgcgacctcggcggcaccccgctccccggtggccgcagcatccgcgacggcctggtcctgcgctcgggtcagctcaaccggctcgacctcgacgccgacccggtggtggccgcgctgggcctgcgtaccgtcatcgacttccgcaccgacgccgagcgcgccgaccaccccgaccggatacccgccggggcccggatgctggtcggcgacgtcctcgccgacaagctgaactccgccgagatgcccgccgcggtccagctcaaggacctgctgtccgacccggccgtcgccgaggagcacctgggcggcgggcgggcgcaggcactgttcgccgacacctaccggtccttcgtgagctccggttccgcgcacgccgcgtaccggatgctgctcaccgaggccgccgacgccggctcgggaccgctgctgttccactgcacggccggcaaggaccgcaccggctggggcgcgacggtcatcctggcgctgctgggcgcggacgaggacacgctgatggccgaatacctgtccgtcaatccggcggtcaagcaggccttcgccccgatgatcgaggggttcacggcggcgggcggcgacccggacatcgcgctcgcgctgatcggtgtcttcccctcctacctgcgggcggcgctggacgaggtcgagacgcggtacggctccatggagaagtacgtacgggaggggctcggcgtcgccgacgggacggtcgaggcgctgcgcgcccgcctggtggcctgaccccgcgcccgcctgccggcccggccccgcaccccggtccccggccggggaccgccaccgccgccggggcccgaaccggtgaccatccgacgattcgctcgttctgctgaacgtgactgcgccggataccgccacccgccccacgccttccgcgtctcccgtgccgccggacgtcgagcaggccgaggccgccatcgtcgagcactacccccggctggtgcggctcgcctatctggtgctgcctccctccctcggccgcaaccggcgggtgctcaccgcccactcgctggtccagcggtcgctgccgcgcgggcggcgggacccgtcggcggccgcggccgccgtaaagggcggggttccggggcagcggggcggggcggacgactccggatacacgtacgtccggctgcgcgtgctgcgcgccgcgctggaggcggggatcccgctgaccttccgggcactgccacggcgcgcgcagctcccgccgctgctcccccaggtatgggggctgcggctgttcccgcgctcgggcggggccgaggagctcgcgctcgaccagtggctggccaccctcgacgggccgggccgggccgcctgcgtgctgcgggccctggaacggctgtccgagccggaggtgctccgggtgctcgacgaggccggggtcccggatccggccgccgcggcccgggagtccggggatccggcgaacgacgccctgttcgcctcgcccgagttcgacccgtgcgtgctccaggcccggcccaccgacctgctgcggcgccgccgcctcgggcgggccgcgctggtcgccggggccgccctcgcggtgtgcggggcgctgctcgcgctgcccggcgggggctggggctccgacggggccgccgccccgctgtacgcgcgcaacgccgcggccgagcaggccctggatcccgcgaagctggtccgggccgcgcccgccctctggcacacgtcctcccgtacggacttctccacctggcccgcccgcggcgaccgggccggcgacacggagctgctgcgccgggcgctggccgtgtgggcccggcccggcccggcggtggtcgcctcggccactccgggcacgccggccggtccgccgatggggccggcccagctgctgttcgcgggtgccgtggaccaggccgtggtggtcctgatgtacgacggcctgcgcgtggtccgctacgcggagccgcgcaccgggaccgcgggcgccgccctcgacttcgcccggaccgacggcgcctcggccgacaccgccaccgcgctggtgctcagccgggtcgacggcaacgtccgctacctcaccgcgccctgggtcaccggcacggccctgcgggacctgctcaagcccgccgcccccgtggtggcgctgaagccggaccggcacggggtgaccccgccggtggcgggcccggccccggcgggcagctgtacgagctggaacgcgctggcggtgaccggtgacggcgccacccggctgatcaccgacctcggtgaactgaccccggcgcggctgacgtcgggcgcgccgggtgccgagcgcgacgtgacggaggccgcggagctcggggactggtcgaggatcgcctgtctgctgccggcggtccgctcgcacggggtccgtacggtcaacgcgtggacgtacgcgaagcagccgctgccggagggcggcgggacggcggcctggctctgcacgcgggccgagacctggcagggtgcggcggaccgggtgcaggcgcagttcctggccccgggtgccccgatggcggcgcaggcggcccggtcggaggggtcgacggcctgcgggccgcgggagccgcgggtgctggcgggcgtgctgtggaagtcgcgggcgggccagtggtacgtactggccgcgggcagtgcgcagttcgcgtcgctgtcggtgtcgggcggcggggtgagcggttcggcgaacggcaaccggctggcggtgaaggcgcaggcgggtgcgcaggtggacctgtcgggcaagttgacggacgggacgaaggcgggggtgctgcggtaggccgtcgcacttccgcgggtgggtgaagcttcaaccgtcaggaaccgtcgggtagttggcgggatccggacatgacggtcgctgccgacacatggcatgatcgggttccggttaccaagcggtaaccccaacacccctcccccacccgaaggtcaccccacgtgcgcacgctcgcccgacgcctcgtcatacccggcttgaccgccctcgccctcaccgccaccggttgcggctccacccctcacaccggagccgccggacccgccgcccccgccgccgtcaccccctcgtccgacggcacgtcgcagcagctcgacgtggccgcggccccgcaggggacgtccacaccggcggccgtggcccgggccgacgggaagggcaagacggagaagaccacgctgaaggtcgcctcctacgacccggcgagcggccgggccgtcatcgccaagggcgcgcagacgcccggccgttcgccctcacccggcaagccgtccgagaccggcaagtccccggagaccggcaagtccccggagaccggcaagtccccggaagccggcaagtcccccgacaccgggaagtcgcccgaggccgacaagccggtggcggtgggcgatgtcatcgccagcgccccggcccccggcgcaccctccggtctgctcgccaaggtcaccgaggtcgtcggcaagaccgacaagggcaccgaggtcaagaccgcctccaccacgctggccgccgtcctgggcgacgacaaggccgacggcaaggtccccgtcgacccggccgcggtcgtcgtcgaacccctgatgaagggcgtcaccttctcctgggccaagggcccgggcctgaccttcggccccgagggcgcgaagctgccgctcggcaacctgcggctcgacgtcaacgcctccgtcgacaccgccccggacgccccggcctcggccggcgcctcggtgtccgggttcgtccagctcgccccgcaggtcgagttcgcctacgacggcggcaccggcggcacccccggtccgcgcggcgccttcctcggcatgagcggcgactggtcctcgcagtggaagctccagggccgtgccgccgcgagcaccggggcgcccaagcggatcccgttcgccaagctgcacagctcgcccgtcatccaggtcggcccggtgccggtcgtcgtcaacctcggcctgacctgctacatccaggtggaggccgacggccgcgtgaccgtcgacgtccagcaggacgtcaagggcgacttcaaggtcggcggcagctacgccctgggcaagggctggaccccggtgagcgcctcgaacgtgaagagcacgccggtcaaggcgagcgtcaccgccgccgggcgggtcaagggcgcgctcggcgccgaggcctccgtcggcctctacggggccgtcggcgtcaccgcggacttcgccccgtacgtgcgcggcgagggagacgtcaaggcgtccgcgtccagcgacggcaagacctccctggaaggcgcctgggcgctgtacggcggtttcgacctgagcggcaacctccagctccagctgtcgctgttcgggacgcccgtcttcgagcggcgcatcccgctgggcaccctcaaccgcgagtgggcgctgtcgaccggccacatcgggcggtagtccgcgcgacagccgtacgcacactgcccgggcgcggccgcgcccgggcagtggcatgtcggagaagtccgcgcagggggcttctcctccctcctacccatcagtacattgacgccatgtctaatacgccgctcgcgcccgcccccgtggcgtcggaacacgtggacctgaggccccggaacgtgtccttcggctgggaggacaccccgctccactggctgcccggcgaccccttcgccggacacatgatcaatgtgctgcacctgctgctccccgcgggagagcgctggttcgtacacgtctacaagcaggtgctccccctcatcgaggacgagcggctgcgggaggacgtcgtcggcttcatcggccaggaggccatgcacgccaccgcgcacgacgacgtgctcccccacctgaagcggctgggtctggacccgaccccctacaccgcccaggtggactggctgttcgagaagctcctcggcgaccggacgctgccgccgggccgggcccgccactggtggctgatggaacgggtcgcgatgatcgcggcgatcgagcactacacggcgttcctcggcgactgggtactgaacgccgacgcgctggaccggcggggcgccgaccccaccatgctggacctgctgcgctggcacggggcggaggaggtcgaacaccgctcggtggccttcgacctcttcatgcacgtggacggcggctaccggcgccgcgcacggacctgggcgaccgccttctcggccctggtgttcctgtggcagcgcggagtgcgcttcttcatggagaacgacccgcacctggtggacggcaaggcctccttcgggaagttcttcctcgccggacagcagggtgtgctcccgtcgacgggagcgatgctgaagtccgtcccgaagtacctctcccgcacctaccacccctcgcaggagggatcgacggcccaggcggtggcctacctcgccacgtccccgggcgccaacggcggggtgcgggcatgaggcgcgccctcgcggtcacggccgtcgcgggcgcggtctgggcgaccaggcgcgccctgaaccgccgcatcggcgactccccgctctggccgctgcccgcccttgagacaccggtctcgggccgttccccgcgccgcgcgctgcgcgcgctgatcgtctcccgtacggagcccgcgcagggcgtgctgcggctgaccctggagtcgccggagctcccggcgtggaccccgggcgcgcacgtggacgtcaccctgccctcgggcctggtgcgtcagtactccctgtgcggcgacccggcggacggcggccggtacacgatcgcgatccggctggtcgaggacggccggggcggctcccgcgaggcgcacgcgcagctggccgagggcgccgagctggagctgcggccgccgcgcaaccgcttcgagctggtcccggcggcctcgtacgtcttcgtcgcgggcggcatcggcatcaccccgatcctgccgatgctgcgggccgcgacggcggccggcgccgactggaccctcctctacgggggccgcacgcgcgcctcgatgcccttcctggacgaactcgcgccctacggcgagcgggtgtcggtcgtcgccgcggacgagacgggcctgcccgacctggcccgcgtcgccgcggccgggccgggcacgctgatctactgctgcggcccggaaccgctgatgcgtgcggtcacggcggcggccgcggatccggcggccgtgcgcctggagcggttcgcccccgcggacgggcccggtccggggcgggccttcacggtcgaactgcgccgctcggggcgggtcgtcgaggtggcggcggacgagagcacgctggccgcggtgcgccgggagctgccggacaccccgtactcctgcgagcagggcttctgcgggacctgccaacaccgagtcctggcgggtgcggtggaccaccgcgacgatctcctcacggaccaggagcgcgcggagtcgatgctgctgtgcgtgtcccgcgcgaagggggaccgactggccctggacctctgaacgctccccagtagggtgtccgcatgacaaccggggtgcgacgcaggatgggtgtcgaggagcggcggcagcagctgatcggggttgccctggagctgttcagcaaccgctcgcccgacgatgtgtcgatagacgagatcgcggcggccgcggggatatcccggccgctggtctaccactactttccgggcaagctgagcctgtacgaggctgcgctgcggcgggccgccgacgagctggcgctgcggttcgtggagccccgggagggggcgctcggggcccgcctgctgcgggtgatgggccggttcttcgatttcgtcgacgaccacgggccgggtttctcggcgctgatgcgcggtggtccggccgtcggcagcagccggacgaacgcgatgatcgacgaggtgcgtcaggccgcctacgagcagatcctcacgcacctgggcatcgggctggagcggccgcccgcgcgcctggagctcgtggtgcggtcctgggtgtcgctcgccgagtccaccgcgctgatctggctggacggccgccggatcccgcggggcgaactggaactgcagctggtgcacgacttcgccgcgctggccgcggtgagcgccgcgtacgacgtggagatggcagggatcctcgtacggatcctggccgacgagccctccgacgggcccttcggcgagctggtcgggcggctcgccgccctggtgccggccgaggtgccggatccgcggtgaatccggggtgtggccgccgcccatgatcatcgataatgcccgcgtgatcattgacgacgagatccggttccggccggccgtggagaaggacgccggcacgctggtgcagctgtacgaccaggccgcccggtggatgcgcaagcacgggatcgatcagtggaagcccggggacaaggacgccgcgcacttccggtcgaagatgcgcgacggcgaggtgtggctcgccggcgatgccgacggccgggtgtgcggggcctacgagttgtggtggtccgacgaggaggcctggggggtccagccgcccgtggcgggctacgtgcaccggctgatggtggcgcgcgaggtggcccccgccggggccgggcggcgcctgctcgaacacgccgagcggcggatcgcccggaccggccgggaacgggcacggctggactgcgtctccaccaacccccggctgctcgcgtactaccggggtgcgggctaccgggtggtcggggagctccctgacaagcagggcaaggacggcaggacctacggggtgatcctgctggagcggcgcctggaccggctcaccggcgtgtgaagacggcgacggtgcgggcggggacggtgaactctcctgtcttcgcgtcgtacgcggactgcttgacggtggcgtcggagcccgcggcctggaccgggtgcagccggtagccggtgccggcgagggcggtgacgcgctgggcctggccggtgggcgccgcgttgaggacgaccaccaggtcgcccagggtcatcgtgatgacgcccggggtctcgtccttgcccgagagggggaaggccagccgggactggacggcttccgccgtggccagggcgaagtccggctcggtggtacggatcttcagcaggtcgcggtaggcggccgaggtggcgccgatgtccgtgcaggtgggtgccggtcccgtgagcagcggcttcgcgtagagccacttcgaggcgttgtcggcggccgggggcaggccgcggccgaagccgttgccgtcccggcagtcccagtggatggcgttgaaccagtcgccgctgtcgaaggagttgcggtccagggacttggagcgcagcaggtcggtgcccgcctgggagagggccgggccctgcgagagggtggccgtcgccatggccaggacctgcatgcgggcctggtcgccggggctggtgccgggggcgagcttgtaggtcagggcatcggcgagggattcgttgtcgtgggcgtcggcgtaggcgagggcgtcgccgggggccgccgcgtagccggccggggcgccgttgtagtcgagctcggagcccttgatgcggcggccggtggtgtcggtgaaggcgtacgaggcgaggttgccggacagcccgaccttgatcaggtcctgggcgtgcaggaggcgggccttctgctgctccggggtgccgttcgcgggcgaggcgttcggggcggtgaacaggccggacgcgaagccctggacgcgcgggtcctcgtcgaaggggccgccgccgcggacggcgtcgcgggcccggtcggagaaggtggcgataccggtgccggccatgttcttctgcgtggcctggacgaagcgggcgtcgtcggcgatctcgccgaagttccagccctccccgtagaggacgatcttcttgccgtcgacgccgtccttggcgggggtgaggccgtcgagggccgcgcggacggccaggatgttggccttcgggtggtggcccatcaggtcgaagcggaagccgtcgaccttgtactccttcgcccaggtgacgatcgagtcgacgaccaggcgccccatcatggcgttctcgggggcggtgttggcgcagcaggtggaggtggcgacggagccgtcggccagcaggcgctggtagtagccggggacgatgcggtccaggacggacttgtccgactggcccgcggcgacggtgtggttgtagacgacgtccatcaccgtgcgcagccctgacccgttgagggactggaccatcctgcggaactcgacggtgcgggccgtgccgttcgggtcgctcgcgtagctgccctcggggacggtgtagtgcagcgggtcgtagccccagttgtaggcgtccttcgcggcggcggcggccacgcaggcctgctgttcctgcgagtccggcgcgtacaccttcaggtcgcaggcgggctcggtccggtcggcggccttctccgggatggtgccgatgtcgaaggccgggaggaggtggacgtaggaggttccggcggcggccaggtcgcgcaggtgccgcatgcccgccgaggcggtgtcggtgaaggccaggtactggccggggtgggtggtggtgcggtccgcgacggagaagtcgcggatgtgcagctcctggatctgcgcggaggtgaaggggacgggcgcgggcttgcgcagggtcttccagccgggcggggccagcttcgggtcggccaggtcgacgacgaggctgtggacggaatccgcggtgagggcggtggagtaggggtcggtgacgaggttgcggaccacttggcgggtgctgggggcccagacggtcacgtcgtagcggtagcgcttcccggtccaggagcgttcgccgcgcaccgaccagacgccggtggcgtcgtcgcggcgcatggcgaccgtgcggccgtcgagttcgagggagacctgctgggcggtgggggcccagacggagagggtggggcggccgtccttgaagacggggccgagggaggcggtggtcgcgtacaggtcgtcgaggacgccggcgagctgcacgccggtggcggcgaggacggcgccgttcgcggcgcgggcgctggcgacgagctggccgcgcagggcctcccgtacgcggtcgcggtcgcgcgggtcgacggtgtaggcgccgtaggcggccaggtgcgggaacttctgcttctgtgcggcggtgagctccgtcctgttcagccgaagccaccgggcggagccggtcagggttccgttctcggccttgacggcgccttcgcgggaggcgaggagctgcacggaggcggcggtggcgggggcgttccaggccagggtgtcgcggtcgatccagacggcctcggacttggtgaggtccagggccgcggcggagccggcgggctgcgggaggaggtactgctgccggccgcccagcatccacacttcgtggccgttggccttcaggtccagggactggtcggtggggaggtccttctcgtcgcccttgtggaggatgtagctcaggctggtggcgcccggcgcgagcgggacctcgtagaccgcgccgtaggagtcgatgcgggtgggcaggagcggcttggaccagtccgtggggttcgcggctccggtccagacgtgcaggccccatccgtcgtaggcgccgtcggggcgctggtggtgcaggacggccttggcctggtcctggggcgggtaggcggggcggtcggtgcgggcgggctccttgccctgctccagccagatctcgccggtcttcgtcacgtcgatggtgcggtcggcggcgacgtccttgttgccgtccttgtcgatgacgaggtagccgacggaggaggcgccgggcttgagcctgacgtacgcgaaggcgccgtaggcgtcgcggccggtgaagtcgtgtccggcgggccacggagtggcttcgccgtcggcgaggtcgccccaggcgtacagccgccagttcgtgtagtcgccgtcggggcggttgtagtggacgaccgcgtagtcccgctgggtggcggtggggatctcggtgggcggggcctggcctgcggcggaggtggcgagggcgctcgcggtgcggccggcggagtcgacggcgacggccttgtagcgcagggcggtgccggccggggcggtgatgtgctgggtgaccttgtagggggcgtggtcggcggtgccgaggacctgccacttgtcggtgccggtctgggcggcgaagaccacgcggttgaggccgccgccggtgacgtcggcggagagctcgacggtgccggtggcgccgggggccggggccttcagggtcagggcgggcttgacggccggcttggcggcgggggtcacggcctggaggacgacggagccgagggccgggacggggagggtgagcttgccggccgccgaggcgcggatcagcgcggtgccgccgtacagggtgcggtactgggcgccggccggggcgtcgatctcgacggtgcgggatgcggtgccgttgttggcggcgaccaggtactcggtgcgggtcctggtgtcggtgcgggcgaaggcgtagacggagccgtcggagagacgttcgctctggacgccgtcgcgcagggccgggtgggccttcgtcagcttcgagagagcactgatctgccggtagagcgggtgtcccggatcgtaggcatcgctcgcgtgcgtgcgcactgttccgagctggtcgtcgtccaggtagtcggcgacctgggtcgcgaacagcggctgccgggcgtccttgtcgccgcccgcgcccgtgaagccctgctcgtcaccggagtagatcaccggattgccgcgggcgaagaacatcagctcgttggccagccggtagcgctccagcagctcctgctccgcggcccccggccggtcctgcttcaggaaggatgcgaagcggcccatgtcgtggttgccgaggaaggtcacctgctcgtaggcgttggccttgccggaggtgtaccggtagtcgtcgcccagtacggaggccagccggcccgcttccgccccctgggaggcgtacgcgcggatcgcgtcctggagcgggaagtcgagggtggcgtcgagcttcccgcgggtcacgtacggggaggtaacggcggtgtcggcggagtagacctcgccgaacatgaagaagtcgtcacggccgcgcttcgcggcgtaggtgtcgagggcggtcgcccactgcgtccagaactcggtgttgacgtgcttgaccgtatcgatccggaagccgtcgatgtcgaagtcccgcacccacttctcgtagatcttctccatcccgtcgacgacctcgggacgctcggtccacaggtcgtcgagaccgacgaagtcgccctgctcggaggactcgcccgcgaaggtggagtccccgcggtcgtggtacatcgtcgggtcgttcagccaggccgggaccttcaggttcttcttcgcgtcgggcacgaagggggtcctcgggaaggactcgccgtccaccttcgggaacttcttcttcccgtcggcgtagtcgctgtcctcgaagggcaccccgtccttggtcagataggggaacgcccccttcgacaggtacgagtgggaggcctcccggtagtccacgacatcggcggtgtggttggtgatgacgtcgaagaagaccttcatccccttgccgtgcgccttgtcgatcagccgctccagatcggcgttcgtcccgaagtgcgggtcgacctgcgtgaagtcggtgatccagtagccgtggtagccggcggaggcatcggccccctggccctgcaccggctggttcttgaagatcggcgccagccagatggccgtggtgccgagccccttgacgtagtcgagccggtcggtgagccccttgaggtcaccgccctggtagaagcccttgtccgtggggtccaggccggtctccaggcgcgagccggtcaggccgccccggtcgttgcccgggtcgccgttcgcgaaccggtccgggagcacgaagtagaactgctcccgggtcaggtcgtgccgggccggttcggcggccagtttcgcgtccgagggcggggcgggcggcggcccgcccggtgcggccgcggcggggagggcgggcaggaacgtcacggccagggcggcggcgagcactcctgcggcagggcgtatcaaggcaggtctccttgtgtacgtgtcgcatggatgagggccgcccggcgtggcggggaagagggtgccggacggccctggtctgtgggacggcagtggcggcggaggcggcagtggcggcggctcagctgcgccaggtgtcggacagcgtgaccttgccgctcgcggggacggtggcggagcggttggcgccgctctcccaggtgacgttcccggcggcgtccttgcggacgtacttgtacgagaacgcggtcccggccgggagcgtgacgtcgagcttccagaccgggtaggccgccgggtcgagcttcagggcgctgccggtgttccagccgccgagctcggcgcggtcaccggtgacgtagacgttctgcccgggaacggtggtggcgttgacgccgaaggaggccccggcggaccccgccggggtaccggagcaggtacgggccccggtgtgcagggcgagggccgtcccggcggcgacggtggcggtgaactgcccgccggagccgaccgtgacggtccgcccgctctgcacgtcgcagtagtcgccgccggggagggaggtctggaaggtgcgggtcagggcggaaccctcgtggttgatcaccacgtacgccttggtgccgcgtccgaaggcgatctggtcaccgccgttgtcccaccagttgccgacggactgaccgcgggcggcgttgcggaagccgaccatggaggagatctcccgccaggcgtgctggcacttccagccgtcggagtagcaggcgttcacggtgcccccgttgggcgggccggcgtccttgtcgctccactcgtagccggagtgcacgtcgggcgacccgtacggccaggccagcgcgaagacgctcgcgagcgtgtaggccgaaccgtccttgtaggtgagggtgtcgccgccccgctcggtgtcgtggttgtcgacgaagaccccggcctgcccgccgggcatgtacccccaggcctcgccgaagttcttcaggtacgcgaggttctcgctctggaagacccgcttgaggtcccgggcgtaccggaactcctgcacgtccccgttgcccaggtactcgccgggcgagacggcctccccggccccgtagatcgcctcctgcttccagtagacgccgggattcgtgagacgggacttgatgttggcgaggtcggcggcgggcatgtgcttggcggcgtcgatccgcaggccgtccacgcccagcgacagcaggtcgttgaggtacccggcgatgcgcccgcgcacgtagtcctcaccggtgtccaggtcggcgagctgcacgagctcacagttctggatgttgccccggtcctggtagttcgagatcgaggcccggcagtcgtccatgtcggcacccgagtagagccccggatagctgtacttcgtgtacgaagacccgccggtgccggtgaaggtggcgcccgcgtccgccggtccggccatgtggttgatgacggagtcgacgacgaccttcaccccggcggcatgacaggtgtcgaccatggccttgaagccggcccggtccccgagccgcccggcgatcttgtagctgacgggctggtacgaggtccaccactgcgcgccctgcacgtgttcctgcggcggcgacacctgcacgtacccgtacccggcgggcccgagggaatcggtgcaggccttggcgacggagtcgaagcgccactcgaacaggacggcggtgacgtccttctcgccggggggcgcggcagcggcctgcggcccgacggcggtgaggccggcggaagcgagtgcggtggcggcgaaaaatattgcagctctgacggctctggcaggcatgcggggggcctcctggcggaagaggtggggattggagcgaccgtaggggccaggtagaaggcctgcaagaccttgcgcaagagattgcagaattgtttccgaggcgtgtcctgccggggccgcccccggactccggccccggcacgccgagttcacccctcggagcaccctgccgccgggctgcgtacggacgttgggtccgaacaggccgcatcggccggggtgcgccaaggcgctgcgcacgacgggatgaaaaacgcccggtcgaccggacggctcgccgtcgaaccgcggcgctgccggctgcggatcctcaatgcctcgaacgagcgtttctggcggctgaggatcgaccctccccgagacgtggcgctccagcccaatcttccgttctggctgatcggcaccgacggtggattccgcccccgctgcagatgctgaacttcctgatcgggcccgccgaacggtacgacctgatcgtcgacttcagcgggatgcccatggggtcgaagttcacgctgacgaactaccacgcactggtgcactacccgggtgtgcccggtctggggccggaaatctcggaagtcacgcagttccaggtcaccaaaccgctgtcctatcccgagacggtgacccggatcatcaccgacccgtggagcccgccggcggaaccgatcgcgggcatcccgaacagcggaaccgagctgccggcgacctacgtccaccactgccacctgctggagcatgaggacgacgacctgatgcgcccgttcacgatcgtcgaccccgacgcccctgttccggtcgaccagggcggcggccacggcggtggcgggcacggcgggcacggccgctgaggtgtcgatcgccctcggatgatcgtgtagcctgcaccctcgataattgaactcgttcaaacatggggggatcatgggcggctcatcacgaggtcggctcggcatcgcactgggggctgcgctcgccatcgaagcggtggggctggcggtggggttcggactctctgagcccacctccctcagacccgactactccgaccccctcctcgggctggacgtcctgctcccggccgaatgcgtggcgatcgtggccatcgtgatcgcactcgcccgccgcaagcccggggcggcctggtgggcggccgcatcggcgacggcgatcctggcggtgagcgtgcagctgctggaggcgggagcggggagctggtccacctggtgcgccatagccctgctcgcgtccttcacgggcatcgtcctctccctcctgcgcacgggccggcccgtaccggagggaggcaacgacaggggcgcggcgcccggccgcctcaccgggaaggccgcgaccgcactggccgtcgtcgcactggtggcgtcgatgtccatgggcgagggaatggaggacgtggactactccggcacctggaccgccggccgcgacgacctcaccctcaccctgaccggcgggcaggacggggggcagtacaccctgcgatggggaacgtgcacagagcagtccgactggaccctggactacccgcagatgacgacttccgtccaggtctggctgatccgcgagacgggcgcgacctcgacctgcctgcccggcaccaagaacatcatgctccgcgtatcgggcggcacctccgcagcaccgaccctcgcgctccccggcccggacggcaaaacgtggacgctcacccgggaatagccacgaagggcgggggcggggcgggggcgggctgacggaagccggcggacggctccaggggcggtggctgcggaaggcgggagctgctcgggcggtggtcagggacgcgtatgggggtttcccgtcagtctcatcgtctctccgtgtcgtgccggtccctcaagggcgctcgttcctcgcgtcgcttcgcgatggccttcggccacccttgaccgaccgacccgccccggaaatccgaagactgccgagaagcccccaaaagaacgagccgggcactcaaggatcaggacggggcggccagagaccccctgcccggtcccgggcgggcacactcccgagacggggcccatccagacccggacccggatcgggggaagcgcgtccaatcgctacgcgctcctgacgtctcagcgtccgacgaccgtcctgggctggacataggccgcccacgacctcgatccgacactcgacctgcgaccgacgaccggccggcgctgggcattgagccgcctcaaatcgctacgcgcttctccgagactgcgaccggcggccggttgggggctgacgagagcctctgagaggggctggcggccgaaacctccgctattccgtcgtggaatcgggtcagcgccaacacgacaccagaaaccaacccccacacgggggcaattagggcaaaccaacggccctttgggtcgcccacgtgcgctgacctgtatccacgacgaaatagccgcagtcccacgccttttcacccccggacggccgtccgccgccgtgaatgagggacagacggatggcgcgcggcgcagaccccgccacggacggtcgtccgccgccgtgaatgaggaatcactgggtggtgggcggcttgtgcccaggccccggccgatcgtcggacgcaggtcgagcgccggattgaggccgtgggcggcctatgccaagcccaggacggactggagacgctgagacgtcaggagcgcgtagcgatgtggtgcgcttcccccgacccgggcccgggtctggatgggccccgtctcgggagtgtgcccgcccgggaccgggcagggggtctctggccgccccgtcccgatccttgagtgcccggctcgttcttttgggggcttctcggcagtcttcggatttccggggcgggtcggtcggtcaagggtggccgaaggccatcgcgaagcgacgcgaggaacgagcgcccttgagggaccggcacgacacggagagacgatgagactgacgggaaacccccatacgcgtccctgaccaccgcccgagcagctccgcacaccgaagccccgccccaccacccgaccccgccccagcggctcccgcacaccgaagcccccgccccgtgttccggctccgcacgcgtggctcccgaacaccgcagccgacccggagcatcccgaccccgcccgcccgactcccgcaccccgaagccaccgcgccttgcggccccgcgccgccgtccctacggggcctcggccgttgagcctcgtaccaccagttccggctggaagacgtactccgtgcgctggaccggggtgcccgagaccgcctccaggagggcgcccaccgccgccgtcgccatggctcgtaccggctggcggaccgtcgtcagcggcggatccgtgaacgcgatcagcggtgagtcgtcgaagccgaccaccgacacgtcctgcggcacccgcagcccccgctcgcgcgccgcgcggatgacgccgagcgccatcgggtcgctgccgcagacgatgcccgtgcagccgcggtccagcagggccatgcccgccgcgtgtccgccctccaccgtgaagagcgtgcgctggatcagcccgtccgcctcggccgacggcagcgccgtcaggaatccctgctccttgcgggccgacggcacgtaccgcgtcggtccgatcgcgagcccgatcctgcggtgcccgaggtcctgcaggtgccgtacggccatgtccgccgccgcccggtcgtccggggagatgaacggggcgttcacctgctcgttgaagccgttgatcagaacgaacggcaccccgcgcgctgccagtcgctggtagcgcgcggggtccgcgtgggcgtcggcgtgcaggcccgacaggaagacgatgccggtgaccccgcgttcctccagctgttccaccagctcgtcctcggtggccccgccgggggtctgcgtgcacagcaccggcgtgtacccgtgcccggccagcgcctgctctatgacctgcgcgaacgccgggaagatcgggttggtgagctccgggatgagcagcccgaccagcccgttgctgcgccgcttgagccgtacgggccgctcgtagcccagcaggtcgagcgcggccagcaccttgtgccgggtgccggccgccacgcccggtttgccgttgagtacgcggctgacggtcgcctcgctgaccgcggcctgcgcggcgatgtccgtcagccgcagcggggaagtcacccctgccaccacaccgtggtgtcggcgggcaggacgtcggggtcggcgaggtcgccgctcgtgagcagcaccgtgcccgcggcgggcagccgtaccggctcgtccgtggtgttcacggtgcagacgaagtccccgcgccggaaggccagtacgccggccggggcgggcagccactcgacgccgtcgcccgcgcccagcgccgggtgtgcgcgccgtacgcgcagcgcggcgcggtacagctccagcgtggactgggggtcgccggtctgcgcctccacgctgagcccggcccattcggcgggctgcgggagccagctgccgccggttccgaaaccgtacggggcctggtcgccgctccacgggatcggtacgcggcagccgtcgcggagtccgtcctggccgttctccttgaagaaggaggggtcctggcgcacctcgtcggggaggtccaccacctccggcaggccgagctcctcgccctggtagacgtacgcggacccgggcagggccagcatcagcagcgcggcggcgcgtgccttctccagggtgccgaagcgggtgcggtggcggaccacgtcgtggttggacagcacccaggtggtgggggcgccgacgggccgcatcgagtcgagcgactcgtcgatggtggcgcgcagtgcctcggcgtcccagccggtgttcaggtagtggaagttgaaggcctggtgcagctcgtccgggcgcaggtacatggcggtgcggtcggcgctgggggtccaggcctcggcgacgccgatgcggtcgcccgcgtactcgtcgaggaccaggcgccaggagcggtagatctcgtggacgccgtcctggtcgaagaagggcaggacctggttgccgagcagcttgagctgttcgtcgcggccgaggtcgggcaggccgggggccttgaccaggccgtgggcgacgtcgatgcggaagccgtcggcgccgaggtcgagccagaagcgcaggatggagcggaactcgtcctgtacggcggggtgttcccagttgaagtcgggctgctcgggggcgaagaggtgcaggtaccactcgccgtccgcgacgcgggtccaggccggaccgccgaagatcgactcccagtcgttcgggggctccgcgccgttctcgccgcggcccgggcggaagtggaagcgctcgcgcagcggggtgccggggccttcgcgcagggcctgcttgaaccattcgtgctggtcggagcagtggttcgggacgaggtcgacgatgatgcgcaggcccagttcgtgggcttcgcggatcacggcgtcggcgtcgtgcagggtgccgaacatggggtcgatggcccggtagtcggcgacgtcgtagccggcgtcggcctgcggggaggcgtagaaggggctgagccagacggcgtcgacgcccagctccttgaggtagggcaggcggctgcggatgccttcgaggtcccccatgccgtccccgttggagtcggcgaagctgcgcggatagacctggtagatcaccgcttctctccaccagccgggctgcgtgccggtggaggtggggagcgcgtcggcgaggtgctgggtcatggtgtccttggagagatcgggccgggggtgagagggggcaggctcgggtggtcagcccttggttgcgcctgccgtcatcccggcgacgaggtgacgctgggcgaagacgaagaagatcgccgcggggatggcgatgagtaccgatgcggcgctcatggctccccagttggaggtgtactgcgtgacgaaggtctgcagtccgccggccagggtgaggttctcctccccgaccatgaaggcggaggcgtacgcgacctcgccccaggcggtgatgaaggcgtagaagccggtgacggccaggccgggcttggcgagcggcaggatgaggcgccagaaggtgccgaaggggttgagtccgtcgacgcggcccgattcgtcgatctccaccgggatggtgtcgaagaagcccttcatcatccaggcgcagaacggcacggcgatggtgaggtacgtgatgatcaggccgagcggctggttgagcaggccgaggtcgcccatgaggttgtagagcgggacgatgaggatcgccatcgggaacatctgcgtgatgagcagggtccacatgagcggcttcataccggggaacttgaagcggctgaccgcgtatccggtggtggcggcgatgaagacaccgaggacggtggtgacgccggcgaccaggacggagttggcgaaccagctgaagaagtggctgtcctccagcaggtaccggtagttgtcgagcgtcggttccttgacgaagtccgtggtgatcgcgtgctgcgcgggcttgagcgaggtcagcaggatccacagcacggggaagacggcgatgaccgcggccacgacgagggtggcgtgcaggccgacggaggcgagcggggaacggctgccccggggacgggcggtgttcgcagtggacatggtcaccacacctctccctgcttgcgcagcgagcgccggtagaccagcgcgaagatcatgagcagcaggaggatcagtacgccccacgtcgcggagacggcgaagtcgcgcgggctcgtgatgaaggcctcgcggaaggcctgggtcaccaggatctcggtggagtcgccgggtccgccccgggtgagcaggaagatcaccgggaacatgttgaaggtccagatggtggagagcaggatcaccgtcatgctcaccgcgcgcagtccgggcagggtgatgtgccggaagcgctgccaggcgctggcgccgtccatctcggcggcctcgtagagctcgccggggatcgactgcaggccgccgagcagggcgaccatcatgaaggggacgccgagccagacgttgacggcgacgacggagaacttggcccaggtcgggtcgtcgagccacgggatcgcggcgatgccgccaccgtcgaggatcttgttgaggatgccgttgtcgcggttgaagaggaaccgccaggcgaagacggagacgaagccggggacggcccagggcaggatgagtgccatgcggtaggcggcgcggccccggaactcccggttgagcatgttggcgagggccagtccgagcgtgaaggtgatggacacgcacgcgacggtccacaccaccgtccacaccagccgctgcaggaacaccgggtcgctgagcacgtccacgtagttgtcgagtccgacgaactcgtacgtggcctcgatgtgccgcacgccgatggtgcgcgagacgttgcgctcgttggcgtcggtcagcgacaggtagacgccccggaccagcggccagccgatgatcacgccgaggacgagcaccaccggggcgaccatggcccaggcgtaccagtgcgtgccgacggcgcgccggaggccggacgcgcctttcccaccgcggctgccgccgcggttaccgctgtcgctgtcagtcctgcggctccggccgcgggcggcgacgtcgttctcgacgtcgtcgcccgcggccttcgccaccgactggctggtgtgagcagccatggtttcgttacttccagcccttgaggatcttgcggaactcgacgccggccgacttggccgcgtcctccgggctagaggccccggtgatcgccttggtgtattcgaccttcagcggctcgaagagggagccgttctccgggatccaggcgcgctcgacggccttgtccacggccggcttgaagaactggaccatctcgctgcccttgacgtccggctggtcgtaggcggcggtacgggtcgggaggaggctgaggtccttggccgactgcacctggacctcctgcgaggtcatgtactcgacgaaggcgtgcgccgcggcggtgttcttggagccggcgtagaccgcgaggtcgtggccgccctgcggggcacccgccttgacggagccggccgggaccgcggcgatgccgaggttggccttgtccttgaactggtcgcccgcgtagctgtcggccaccgcccacggaccgttgatcatcatggccgcctggccggtcttgaaggcggtctgcatgttgttccagccgtcggtggcgttggtgatcgccgcgccggaggtaacgaggtcacgagcggtcttgaaggccttgacgcccgccgggttgtcgacggtgaccgtcttgttcttggcgtcgaccaggtcgccgccctcgccgtagatgagggggaggaaccagtaggagtcgtcgccgcggaggtagaggccggccttgccggtcttgtccttgatggcggcggcggccgtcttcagctcttccagcgtggtggggggctggacgccggcgtcggcgagcatcttcttgttgtagaagaggccgagggtgtcgatgacctgcgggactgcgtaggtcttgccctcgtacttgccactggccgcggcctgcgagaggaactcggcgtcgaccttcttcgccgtctcggcggggacctcgtcgaggtagcccagcgaggcgaagtccgcgacccagccgacgtcggcgcggatcacgtcaggggcgtcggagccgctgctgaaggcgttcttgaccttgttctgcgcgtcgccgtacgggacgttgacgtacttgacggtgaccttggggtgcttcgcagtgaacgcctcggcgatcttctggaagctggccttctcggcgtcgttcgaggtgtcccaccacgtgaccgtgccggaaagctcgccgcctgcctgggtcccgccggccgcgtccttgtcgtccccaccgcaagccgtcgccgcgagcgccagggtcgcgaccagcgcggtggccgctatgccacgccgcatatgaactccttcgatgatcccggccgcgccctcgcggtcccgagttgccaggaacgtaacaagactgaaagaggaccgaaagaccttgcgcaaactttctgcaagcggaggcgatcgttacatccgtgtgtccgtacggttgccgcagcttgctgttagttcgagtcaccttcgaccacccgggcccgcaaccagggggcatgtacccgcgttgaccccgatatgacccacgactcgacggccgtccagcttgcaagctcttccagcaacgcgaccgcgagcggtggctggtggcgcgatgccgtcatctatcaggtgtacgtacgctccttcgccgacagtgacggagacggcatcggcgacctccgcggggtccgctcccgcctcccccacctcgcccgcctcggggtcgacgccgtgtggctcacccccttctacgtctccccgcaggcggacggcggctacgacgtcgccgactaccgggccgtcgaccccctcttcggtgatctctccgacgccgacgagctggtccgggccgcgcacgcgctggggctgcgggtcatcgtggacgtggtgccgaaccacacctccgagcagcacccctggttccgcgccgccctcgccggggatcggggcgcccgtgagcgctaccacttccgtcccgggcgggggccggacggcgccgagcccccgaacgactgggagtcgatcttcggcggccccgcctggacccgggtcccggacggcgcgtggtacctgcacctcttcgcccccgagcagccggacctcgactgggaccaccccgaggtcgccgccgaattcgcctccgtcctgcgcttctggctcgacctcggcatcgacggcttccgcgtcgacgtcgcccacggcatggtcaaggccccgggcctgccggacatcggccgcggcgcccaggccaccctcatcggcaccgagccgctccccttcttcgaccaggacggggtccacgagatccaccgctcctggcgccgcctcctcgactcctacgggggcgggcggatcggggtcgccgaggcctgggcgccgacctccgaacgcctcgccctgtacgtacgcccggacgaactgcaccaggccttcaacttccggttcctgaactgcccgtgggacccggtcgcgatgcgcaccgtcatcgacgagtccctcgccgccaccacctccgtgggcgccccgaccacctgggtgctgtccaaccacgacgtcgtacgccacgtgacccggtacggcggcggggcccgcggcctggcccgggcccgggccgccgcgctgctgatgctggccctgcccgggtcggcgtacgtctaccagggcgaggagctcggcctgccggaggtggtggacctcccggaccgggtccgccaggatcccgccttcctgcgcaccgccggacaggacgggctgcgcgacgggtgccgggtgccgctcccgtggtccggcgcggagcccccgtacggcttcgggccgacgggcagctggctcccgcagccggccggctgggccggcctcagcgtggccgcgcagaccggcgacccgcactccacgctggagctgtaccgcgccgccctggaactgcgccgggcgatgccgggcctgggcgcaccggaggccgggacgggggcgggagcggagccgggggcggcggtgggggcggagccggacgcctctgccggagccccgtacgcgtgcgggatgcgctggcagtccgcccccgagggcgtgctcctcttcacccgccccggcttcgcctgcaccctcaacagccgctccgagccggtggagctcccggcgcccggtcgccccgtactctccagcgccccggtggagacggacggccgaaccgtccggcttcccccggattcgtgcacgtggtggtcatggtgaacgtccgaccggtacagtccaatcccgtgaccgcacggctagccgacatcgcagcccaggcgggggtcagcgaagccacagtcagccgcgtgctcaacggcaagcccggcgtggccgcaggcacccgtgaatccgtgctggccgccctcgacgtactcggctacgagcggcccgtgaagctgcgccagcgcagcgcggggctcgtcggtctgataactcccgaactggacaacccgatcttcccggcgctcgcccaggtcatcggccaggccctgacccggcaggggtacacgccggtgctggccacgcagacgcccggcgggtccaccgaggacgagctgaccgagatgctggtcgaccgcggggtctccgggatcatcttcgtctccggcctgcacgccgacaccacggccgacatgggccgctacgaccaactccgcgggcagggcgtcccgtacgtcctgatcaacgggttctccgagaaggtgcaggcccccttcgtctcccccgacgaccgggccgcgatgcagctcgccgtcacccacctcgccgcgctcgggcacacccgcatcgggctcgcggtcgggccgaagcgcttcgtgcccgtcctgcgcaagatcgagggcttccggctcgggatgaaggagcggctcggactcgacgaggccgagagcgagcagctgatccagcactccctctactcgctggagggcgggcaggccgccgcggccgcgctgatctcgcggggctgcacggcggtggtgtgcgcgagcgacatgatggcgctcggcgcgatccgggcggcccggcagcaggggctgcaggtgccgcaggacgtgtcggtggtcggcttcgacgactccccgctcatagcgttcaccgacccgccgctgacgacgatccgccagcccgtgcaggcgatgggacaggctgcggtccggaccctgctggaggagatcggcggtacgccggcgccgcacagcgagttcgtcttcctgcccgaactggtggtgcgcggctccaccgcctcgggcccggggcagcgccgccgggacgaggccgttccttccggatcatgacggcccgcggtgtccggcaccgcgggccgatccgccccggtccacggggccgccggggcgtacgcgaccgcgccgggtcccccgggcggcccggctgagggttccgtgtcgtacccaaggcggaccgcaggcgccgaagaccgtcccgagggatgatcggaggcgggaacgcatctggcagactctctccccatgggtgaatcgagcgtgaagacactggaaacccggacggacgtctcatcacccatcgcggtggagaccgagacccgcccggggtccgagcgcaccctgctctcccggttgcgtgccccgcgccggcctcggatctggttcgaggtgctgctgatcgcgatcagctactggacgtactcgctgatccgcaacgcggtgcccgagcagaaggcggcggccctcgccaacgccgactggatctggagcgtcgagcggaccctcggcatcgccgtggagaagtccgtcaaccacacggtcgactccgtgacgtggctgatcgtgggcatgaactactactacgccacgctccacttcgtggtgacgatcggcgtgctggtctggatctaccgtttccatcccgggcggtacgccgccacgcgcatggtcctcttcgccaccacgggcgtcgccctggtcggctactactgctacccgctcgcgccgccccggctgatgaacgggcaggacttcatcgacaccgtgctggtccaccacacctggggctccatggcctcgggcaacctcaagcagatgtcgaaccagtacgccgcgatgccgtccatgcacatagggtggtcgctctggtgcggcctgacgatcttcgcggtggcctcggcgccctgggcccggatcctgggcctgctctacccgacggcgaccctcgtcgtcatcgtggccaccgccaaccacttctggctcgacgccgtgggcggcatgctctgcctggcgttcggctacacggtctcgcggtcctggtacggctccttcgcccaccgcctgccccgccaccccgagcacgcgggcccgcacccggccacggaactgctgaaccgggtccgggtccgcacccgcgcctgagacgaccgccgcgctactgctccccgagggccatccacttcccgggcgtggcgaggggcgcgaagccggcccgggcgtagacgtcgtgcgcgtcggcggtggccagcaggacccggcgcagcccgtacggctccaggtgcgcgcacaccgcgtcgaccagggccccgccgagcccctttccgcggacgccccgatcgacgtagacgtcgcacagccaggcgaaggtggcccggtcggtgacgacgcgggcgtaggcgagctgggccccggaggcccggtcgtagaggccgaagttcaaggagcccgcgatggcgtcctcctgcttccgcaggctgcgcccgagcgcccagtacgcgtcttcggacagccacctgtggacgagccctacgtccagtcgggcggcgtcggtggagatctcgtatccgtcgggaaggtcgtcgctcatcccggcatccaaccagcggcggcgcgctccgtgccagcgcatatccgcgtcagcacgcgcgctcgtactcgacctgggcgaggggcttcccgtcgccgaagtcgaaggggcgtacggtgccgctctcggtgaagccgcacttggtgtagaagcggcgggagcgcggggtgtcgcgcagggtccacaggtgggtccgtgcgaacccgtccgcgcgcaggtgctccagggtcccggtcatcagcgcggccgcgatgccggtgccccagccgtcggggtgggcgtagaaggagaggatctcggccaggcccggccgggtcgcggatgcgcggaaggcggtcatcgccagcgggcggccgtcgtgttcggcgagcaggatcggggtgtccgcctgcccgaccctcgcgtgccaccgcgttcgtctgctccggactccgtcggcggcgaacccgggctcgaagaagggggcgtacgccgcctcccaggccgtggcgtggatctcgccgaggacgtctgcgtcgttccggcctgcacgtcggactgtgaacatcccaccaccgtatccccgccgcgttcccgggcacggggctccgggcttctcccggtcgtggggagggggccgcggtcgtacggtggaagaaggcgcgtgcgccactcgcccgcgggccgggacgcgatggtgaaccgcgcgttcgagcagaccgggatcggcacgaacggtctgtacgccgtcggacacttcgccggccggtcgagacggccgcacaccgatgaccaccggccgccgctgaccgccgatccagcaggcattcggagagcaggtacgtccccatgcacaagtcgccccgtatcgccggtgtcctcgccggcctgttcctctccctcgccggcgcggccgtcgccgcgcccgccgcccacgcggacatccccgcctgtacgaacatggccgcgcagtcgggtgccgaggtcaccgacgccgtcgcggcgtcctgccggcgcggcgtggtcggtgatctgcagggctgcgtgagcggcctgaccgaggcaggagtgccgggtggcgccgcgaacggcgcctgccggaccgcggccctggaaccgcggtagaccgatcgcagcgcccgtttccctccgcggggaaacgggcgcactcgtgcgcgaaacagtgacatgcgtcacggtggccatacctgcggggagctttcttgacggagcgttaacccgtcgacatttcgatatttgtcccttttggaattgacattcccctctccgccggaaacggaatccctcataccggcgaacccgtccccgaccggccaggtcacagccgtttctgatcacccatcagacggttgcgggagtgaccaaatcgtgatgatgcacgatcacggtcccgtttcaagccgtgtgccgaccgccccaggcttgtgatcagcggaaacttgccaggccattcagaggcttttaagaatggcggcctcttcggcgccccgcgcttccggcgccggaagcttcgcgatcactgaatgaggtcaggcatgcagaagcatcggaagaagacgtcctacaagaaaatagccatcggtgtcggcgcgctcgccatcgtgggtgtccccaccgccgccatggcctgcttcgacggtcaggacgagggcaacagccgtacgcggaccgtgagccaccagcagcagcgcccgtggcagtgggcgccctcggccacccccggcaccctggcgcccgtggacgccccgctcccggccacgtcgccgagcggcagccccgccgaggcctcccccagcagccctgcgcccgagaccgcaccgcccgtcgtggagaccacgcctcccgcgcagcccaagccggcgaagccgccggtcgccacgaagaagccgacgacgacggcgccccagccgtccaagcccgccgccccgccggcctcgggcgacgtcgccgcggtcctcgcgctcgtcaaccaggagcgcgcctccgccgggtgcccggccgtctccctcaacgcgaagctcacgaaggccgcgcaggaccacagcgccgacatggcctcccacagcaacatgtcccacaccggttccgacggctcggacccgggtacgcggatcacccgcgccgggtacacgtggagcacgtacggcgagaacgtcgcctacggctacagcactcccgagaaggtcatggagggctggatgaacagccagggccaccgggagaacatcctgaactgctccttcaaggagatcggcatcggcctggcgcagcccggctcctactggacgcaggacttcggcgcggcgcgctgacccgccccgcccctgcccggcccggccgcgccgccgtcacggcggcgcggcggcgcggccggtcacagcctgaacagcactccgcgccaggtccagcccgcccggaggaccgtgttctgcagggggttcttcaccagccccgtgtcgaagcggaacgtctccaccttgtggcggcggccgtcagcgcccttgcggaactcccactgcttgtagaccgccttcgccggaccccggccgtactgctcaccggagtgttcgagcgagggctcccaccgctcttcgagtacgcgcacctcgtgcttcccggggaccagtcgcatgctggtcctgagggtcaggcgcgcctcgctgacgcggcactccaccaccaggtcggcgcgctcccgcgcggttccctcgcgtacggcgaacagctcgtccggaccgcccagcgcgagcagcgcctcccggagctccccggcgccccgccgcggcacactgccggccggatgccgtgtgcccgtgcgcctgtcccagaagccacccaccgtcagctccccgccccgtcgtccgggcgcacggtgcgtacgaagtcctggaagtcgcccaggaggctgtcgtgctgggccgcggtgacggtcagggccaggcggatcatcgcccgcttgtgcgggtccccggtgtccacgaggaacaggtacacctgggtctggacgagctcgtggcgggcgccgtcggtgtcgaacgagaagcccagccgctgggtcagggcgggcgcgtcctcggaaccggcctcgcggcggtggaccacctccaccgactcggcgaactcgcgcagccgctccaccgacgcgtcggcgatctcggccagggccaccccgtccttcgggaacccgccgtcgatggtgatgttggcggtgaacccggcgtccggctgcggatgcaccgcggcgaaggccactcccgggtcgaaaccctccggacgggccgggagccagccttccggcagccggaactcgatcggcaccggcagtgtcgtgggcatcctgggccctccttccatggaaacggacatcagtcgagcaaccagtccttgaagtcgcccgcggcgtcgccgaccgcgtgcgccgtgtcgcccaccgcgtcggccacgtcgcccgcggtcttggccaccttctcaggatcgacggtgatctccaggcccagggagccaccgacgaagggtgaggccccggccttgccgccgatcttgtatacgccggtctcctcgtccttcttgtagccccaccaggcctcggcaccggggccggcccatccttcggccgtcaggccgacgcctatgccgccggactccgctcctccggcgagagtgcccttcgccccggcgaacgccttcccgccgatggtcacttcttccttggtcgccttgaggctgcccgacagctcgccgccggcgaagccctcggcccgcccgtagacgctctggtactcgcccccggcccggccctccgccagtgcccggattcccgcggacgcctcggccttggcgaccatgcccttgtcggtgaagccgaagttcgcgctggcccgggctccgtcgtagatgtcggcgaccccggccagcttcagcgacccgatgctcccctcccccttcgctgtctcgtggaagaggtcgacgtagaccttgcccgaggcctccttgccgtactggcccgggccggtgctgctcgcgccggcttcccagccgtcggtcctcgtccggatcttgacctcttcgagcttcttggccttcgccaggtcgccctcggcgtagttgttgaagccggtgagggtctcgtcggcgccggtgccctggcccagggcgtccctgttgctgtcgttcacggccgccaggagggcgtccttgacgtgctggtcggcctcggaggcggccttgacccggtcgtcgatgtgcttctgccacttgccgaccgcggtgcggacggcctcctggccgtcggggtcgtggtggtaggcgctgcgctcggagggcgtcagcttggagtagtcgaaggcgacgtgcccctgctccgagacggtcatgccggcggcgatcgcgtcgtcgcgggcgctctccagcttcttcttgaggtcggtgagctgttcgtgggcaccccgcagcaggctcgcgacggccttggcctggttctgcgcggcggagtactcgtagcgggtcgccgtgaacttcacccgcgccgtcgcggcgctgacaccgacccagttgtctcccatggtgatcttctggacggtgtccccgtagcgggtctcgaccttcttcagctcgcccgccatcgagtcccacttggcggcggcggccgtcagcaggcccaggtccgtggtcatgacttcgtagtaggtcagcaccgcaggcccctatatcccgttcagttgcgagtgcgacgcgaaccggttgcccaggttgatgtcgttcccggcgatggatccggcggcgccccgcagcgcggtctcctccccggcgaggcggcccatgagggtcttcacctgctggtcccacgtgtccgccaccttctgcaggccggcggccgtctcccagccctcgaagcccttccgggcggtgctggtggcgtcgtccgcgtgttccgcggcggtcttggtggcgtgcttcagctcgttctggatcgtgtccgccgccgccttcttctgggcgggcgtcgagacgaagtccggggagccgcccggggtgaacaggttcgacgacggcggggtgacccccggcgcgtacgggaccaccgacggcgcggtgacgcccggcgcgtatggtccgggcgtcggggtcacccccggcgcgtacggtccgggcgtcggggtcacccccggcgcgtacggccccagcggtggcccgctgttcagcctcatctccacctgctggtccgatgcctgacccggctcgtcgatcatcctcgcgcctccccgtaagcgaagtctgatcatatgcaaagcgtgaaggcaacagccagccccgccagggcagttgggcgccccgcggccgcacggcccgcagcggctacgccccgtagaacagttcgtccacgaccgcgcgggcacggcgggtgatgcggcggtagtcgtccagcaactccccgaccgtgccctcggcgtagccgaggtagcggccgacggccgcgagttcccgggcctcggtcgggaaggtgtccccggcgcggccgcgcaccagcatcacggcgttgcggacccgggtcgccaggacccaggcctcgtcgaggatctgcgcctcctcggtcgggatcagcccggccgcgtgggcggccgcgagggcctcgcgggtacgggtggtccgcagacccggttcggcccaggcgtgccgcatctggatcagctggacggtccactcgacgtcgctgaggccgccgcggccgagcttggtgtgcagggtcgggtcggccccgcggggcagccgctccgactccatgcgggccttgaggcggcggatctcgcgtacggcgtcctcgccgagcccctccatcgggtagcgcagcgggtcgatcagctcgatgaagcgggcgccgatgtcggcgtcgcccgccaccggttcggcgcgcagcagggcctggctctcccaggtcagggaccagcgccggtagtaggcggcgtaggaggccagcgtgcgcaccagcgggccggagcggccttcggggcgcaggtcggcgtcgatgagcagcggcgggtcggtggtgggcagctggagcagcctgcgcatctcggcgacgacggtctgggccgccttggccgcctcctgctcgtcgacgccctcgcggggttcatggacgaacaggacgtcggcgtcggagccgtagccgagttcgtggccgccgaagcggccgacgccgatgacggcgaaacgggtgggcagcgtgtcgccgtagtggctgtggacggctgcgcgcagagccccggcgacggtggcggcggtgaggtccgagacggccccgccgacccggtcgacgagggcgccgtggtcctcctcggccgggttgtcctccgtaccgtacgagccgatgatgtcggccgcggtggtgcggaacagctcgcggcggcgcacgccgcgggcgacggcgacggcggcctcggggttctcggcgcggccgacggcggcgaggacctcctgctccagcgcctcgtgcgtacggggctgcaggccttcggggtcgccgagcagggccacggcctcgggggcgcgcatcagcaggtcgggggcgaggcgcccggcggacaggacgcgggcgaggttctccgcggcggcgccctcgtcgcgcagcaggcgcaggtaccagggggtcttgccgagggcgtcggagaccttgcggaagttcagcaggccggcgtccgggtcggcggagtcggcgaaccagccgagcatcaccggcagcagggtgcgctggatggcggccttgcgggtgacgccggaggcgagggcttcgaggtggcgcagggccgaggccgggtcggcgtagccgagggcttcgaggcgctggccggcggcgcgcggggagagccgggtctcgcccggggcgagctgggcgacggcgtcgagcagcggccggtagaagagcttctcgtgcaggcgccggaccacggaggcgtgccggcgccaggccttgttgagctcggcgacgggttcggtgcgcaggcccatggagcggccgaggcgccgcaggtcgttctcgtcctcggggacgaggtgggtgcggcgcagccggtagagctggatccggtgctccatggcgcgcaggaagcggtacgcgtcgtgcagttgggcggcgtcggcgcggccgacgtagccgccggcggcgagggcgtgcagggcgtcgagggtgctgccggagtgcagggtggcgtcgctgcggccgtgcacgagctggagcagctggacggcgaactcgacgtcgcgcaggccgccggggccgagtttgagctcgcggtcgacctgggcggcggggatgttgtcgacgacgcggcggcgcatcttctggacgtcggcgacgaagttctcgcgctcggcggcctgccagaccagcgggcttatggcggagacgtactcggcgcccagggcctcgtcgccggccacggcgcgggccttgaggagggcctggaactcccaggtcttggcccagcgttggtagtaggccaggtgggaggcgagggtgcggacgagggggccgttgcggccctcggggcggaggttggcgtccacgggccagatggtgccctcgacggtggtctccgagcagatccgcatgaggtgggaggcgaggcgcgtggcggcctggagggccttggcctcgtcggcgccgggcgccgcgtcgccgacgaagatgacgtcgacgtcggagacgtagttcagctcgttgccgccgcacttgcccatcgcgatgacggccaggcggcacagggccgcgtcctcgggggcggcggcggaggcgatccgcagggccgcgcggagggtggcggtggcgaggtcggcgagctcggcggcggtctgggagacgtcgatggtgccgcagacgtcgcgggcggcgatggagagcaggcagcggcggtaggcgacgcgcaggccgacggggtcgtgcgcgtccgcgaggccgagctcgaactcggcgagcccggggtgcaggtcggcggcctcatacgtgacgaggctgagccagtcgcgggggtggcgggccaggtggtcgccgagggcctcggaggcgcccaggacgccgagcagccggtcgcgcagcggcttggcgctcaccagggtgtcgaggagcccgggcagctcgccgtccggctgggcctcggcgagccggaccagcccgaggagggcgaggtcggggtcggcggtcgcgccgagggcgtcgagcagcacgggatcggtgcgtacggccgcgagcgcgtcggtgtccagcagccgggcggcggcggaggggtcggtgaacccgctgcggagcagccggatgaaggtgctgctcctgcgtcccgggaccgtcatcccgccgcctcccgcggttgtcgctgccactgcgtgccactgctcgccggtgcggcgggctctgctcctgagcctaggccctggtgcctgtgagcggagtcccgcccgggccgcggtggagatttaggcgtgtccggatcaaatgttcgactctcgacgcatacgatgccaaggttcatctgatcatcggattacttatcgcgtcatgggggtataccccgccgtccggccaggaggagccacgtgtccgactcctggcagggccccgaggaccgggaccgcccctccgagcaggcgcaccggggataccagggctaccggcagcaaccgcagtattcgacgcaaccggcgcaccagggccacccgcagccgtacgcgcacccgcccgagcaggcccgccggctccaccaggtccaccaggccccgacgcaggccgacttggccgagccgatcgaaccggccgactcgaccgaaccggccggaccggcaggaccggcaggaccggcaggaccggcaggaccggcaggaccggcaggaccgcttccggtggccgaccccgtcgccccgcccgagcgccccgaaacccccgacgcgcccgatgcccccgatgcccccgatgcccaagcccccggtcgccgccgccgggcccgcggcaagggccgggcgcgccgtcgccgggccggcctcgtcaaggtcgtcgtcttctgcgtggtcaccgccgccggcagcatgctcctgctccgcggcaacgagatcctcgaccgcctgggctcccccgcgacccccgacaaggcggccggcacgcccacccccgcccccgagccgcccgaccccggccgggtgctccaggtcgtcgcgcaccccgacgacgacctgtacttcatgaacccggacctgcggtactccatagccaccggccaccccgtcacctcggtctacctgacctccggcgaggccgacggcatcaacgccggctccgccaaggcggccaccaccaagcccgacaagcccgcctacgccgaggcccgccagaacggcatccgcgccgcctacgccaagatggccaccggcgaccggggcagcccctggacgcgcaccgtcgtaccgaccaagggcggcggtttcgccgaggtcgacgtcctcgtcgccaaaccccacgtcaacctcgtctggctgcagctccgcgaggccggcaccgtctacgacagcgtcccggagagcctgcacggcctgtgggacggcaaggtcgcccgcctggactccatgctcgcgtccggcaccccggtcacgcagaagttcgcgtactccaaggaccaggtcgtccagaccctcgtcggcatcctggagcagtaccggccgaccaccgtccgctcgcaggacccgacccccggccggtatgccgacaccaagcggtacaccgaccaccaggaccacttctacggtgcccggttcgtccagctggccaccaccgcctacgccaaggacgtcacggaccgcccgcacttcgcggtgcagaactacgccggctacatcaacggctcgctgcccagcgccctggacccggacgaggccagggagaagctggacatcctgggcacctacgcctggctcgaccagcagaaccactgcaacagcccggccggctgcggcgacctcaaggtctccgaccagcccggcggcaaccggtggtcggactccatcaactacgcccgcggtaccagcaccagctggctgacctccgacgcggagctcgggctgtgggccttcaaggtgctcgacggccaggtggccgtctggcaccgggccggtcccgtcggccgctggaagggcccggacctgcttcccggcaccggcatggacccgggcgtcagcaccgtgaccctgccggacggccggatagccgccttcggcacccgcacctccttcggcgcgaagcccgccgactaccggcgcgaggtcgtccacgccgtccagaagcagccggggtccggggagttcacggagtggcagtcgctcggcacccccgagagcgccgacgagacctggacttccgacatcagcgccccggccgtatcggtcgacggcagcggccagttggcggcgtacgtccgcgacggcgcgaacagcctgcgcggccgggtgcagcgcgcggacggcggttggggtccctgggagaagtacggcggcaccgacctgcacggctccccggccaccgcgaccgacggcgccgggcggcgcatggtgttctgcgccacctccaagtcggtggtgggctgggtgcagcccaagccgggcgccccgctgggccaggtcacggccaccgggctgccggacaccacgctcccgctgaccgcggacgggcgcgagggcggcgtacggctgtggttccgcaagcccggctccggcaatgtccgcaccgccctcgtcacgggtgagggcgggctgaaggtgagccagatgaccgacctcggcggcctccagggcttcggctcggtgacggcgagcgggcacgtgctggcgggccgcaccgcgggcgggcaactgggctcggaggccgggccgggcgggccgtgggaacggtccccgctgatgttcgtcggcgcgccctcctccacgatgaccggcaggaacctggtcagcctggcggtggtggggctcgacgcgcggctgtacgtgacctcctcggcggacacgccgaacgcgcacctggcgccgtggcagccggtgggcccgcgcaacgcgcctccgtacccctccgcaccgtaggcggacggacaacgtccgtattttgttggagaaatgcggcggacatccgcgcgttcggtgaaccaagtccgccggttcgccctctctctgactgttcaaggctttcttccgtcagagcgagaccgaacccgaggcgtgacccgatgcccgtgacccgtcgccgcttcgcggccctgctcaccgtgctgacagccggcgccaccggcgtgctctccgtggccaccggccagcagaccaccgccgaagccacccaggacaagaacccggccgcggcccagcccgcgagcgtcaccgccggatcggtcgtccaggtcgtcgcccatcccgacgacgacctgttcttcatgaacccggacctcagccggtccctgctgtccggcacccaggtcaccaccgcctacctcacctccggcgagtccgacggccgcaaccaggcccgcggcggcgccgccacggaccccgaacagcccgccgaccgcgcccactacgcggaggcccggcagaacggcatccgctccgcgtacgcgcagatggccaccggggaccgcaccagcgcgtggaagcgcacggtcttccccaccgccgggggcggccgggccgaaatcgacgtcctcatagcgaaaccgcaggtcaacctggtgtggttgatgctgcgcgaggcccgcaccaccggcgaggacacccccgagagcctgcgcggcctgtggaacgggcggatacccgcgctggactcccagctcacctccggcaccccggtcaagcagccgttcacgtacacgaaggaccagctcgtcgagacgatagccggggtcctggagcagtaccggccgacgacgatacgcatgcaggacccgacgccgaaccggtacggcgagaacgggaccggccggtacaccgaccaccaggaccacatgtacggcgcccgcttcgtgcaggccgccaccgccgcctacgccgaccgggtcagcaggcgcccgcacttcgcggtccagaactacctcggctaccacaacagcaccctcccgcacgcgctggacccgcagaccgccgaggccaagaccggcttcctgaagacctacgcctggcaggaccgccaggactactgcggcagcccgtcaggctgcggcgaccgcaaggtcgcgggcaacccgaccgggcgcaactgggcccagtcgctgcgctacacccgcgccgaccacacctcctggctgacggagggaagccccggccggctgtgggccttcgccacgctggacggccggaccgcgtactggacgcgcacccccggcggtgactgggcgggcccgatgttcctcccggggacgggcatcgacccgggcgccaccgccgcccgcctgcccggcggccgcatcgccgtcctcgccacccgcaccaccctcggccccgcgcccgcggagtaccggcgcgaggtcgtgtacgccgtccagtccgtgcccgacggccccttcggcccgtggcagtcgctcggtaccccggagcgcaccgacgacgagggcacctcggcgatcagcgcccccgcggtggccgtggacgcgcggggcctcctcacggtctacctccgcgactcgcgccgcaccctgcgcgcgagcacccaggagcccggcggcggcttctcgccgtgggagcggctcggcggcgaggacctgcagggcgatccggtgacggcgaccgacgcggcggggcggcgccacgtgtacgcgaccaccaccacgtccgtcctggcctggacccagcgcaccccggacaccccgctgctcggcccggcaccgacgggcctgccggccaccacggtccccctctcggcctccccggagggcgcgggcgtccgcctcttcttccgccgcccggactcgggggtcgtgcgcaccgccctggtcacggcgggcccctcggtccggccccacgtctccagcgtcaccgaggcgggcggccgcgccggctacggcgcggtcggcaccgcgggccgcctcatcgtgggccgcgcggacagcggcacggtcggcaccacgggcctcggcggccccccggcgtggaccgagtcccgcatgctcttcgcgggcgccccgtccgccgtcctcgaaccctcgggcaccaccacgacggcggtcctgggcctggatgccgaactccacacgacgacgacccccggcacccccaaccaccccacctggcaccgcgcggtccactgacacccgccgcccgggcccggtaggccccctatggcgggacgggtccgggccgacggtctgcgaccgccggcccggagtgtggtgcgggccccgtcgggggctctgaactgcccctacaggacggggaggttcttgcggagttcgaaggccgtgacctccgagcggtactcctcccactcctgcttcttgttgcgcaggaagaagtcgaagacgtgctcgcccagggtttcggcgacgagttcgctgcgctccatcagggagatggcctcgccgaggttctgcgggaggggttcgatgcccatcgcgcggcgttcggcgtcggagagggcccagacgtcgtcgtcggcgcccgccggcagttcgtagccctcctcgatgcccttgaggccggccgccaggaggacggcgtaggtgaggtacgggttcgcgcccgagtcgatcgagcggacctcgacgcgcgaggagcccgtcttgcccggcttgtacatcgggacgcggatcagcgccgagcggttgttgtggccccagcagatgtacgagggggcctcgccgcccgcgccggcgctgcgggaggagccgccccagatgcgcttgtaggagttgacccactggttggtgaccgccgcggtctcggccgcgtggcgcaggaggcccgcgatgaaggagcggccgaccttggagagctggtactcggcgcccgactcgtagaaggcgttgcggtcgccctcgaagagggagaggtgggtgtgcatgcccgagccggggtactccgagaacggcttcggcatgaaagtggcctgcacgccctgctcgagggccacctgcttcatgaccaggcggaaggtcatgatgttgtcggccgtggagagcgcgtcggcgtagcggaggtcgatctcctgctggccgggggcaccctcgtggtggctgaactccaccgagatgcccatggattcgagcatggtgatcgcctggcggcggaagtccatgcccacgttctgcggggtgtggtcgaagtagccggagttgtcggccggcaccgggcgggtgccgtccagcggcttgtccttcagcaggaagaactcgatctccgggtgggtgtagaaggtgaagcccaggtcggaggtcttgttcaggatgcgcttgaggacgtaccgcgggtccgcgaaggacggcgagccgtccggcatcaggatgtcgcagaacatccgggcggtcccgggggcctccgcgcgccacggcagtatctggaacgtgctcgggtccggcttggcgatcatgtcggactcgtagacccgggcgaagccctcgatcgcggagccgtcgaacccgatgccctcgtcgaaggcctgctccagctccgcgggcgcgaccgcgacggacttcaggaagcccagtacgtcggtgaaccacaggcgcacgaagcggatgtcgcgctcctcaagcgtccggaggacgaattcctgctgcttgtccatgccttcatcctcgcagttcagacggcctgtgcaccaccgctcgacagtcggcgcacagtcgggcgcgccaagtatcgccagtcgtggtttccgccacattacgcacccgggaaagctggtggcacccccgcactgaccgggggccggtcatgagcattaccatctgcgcccatggggggccggcagcacacgcagccggggcgtcgcggacgtcccggacttcggcgtgccgtcctgctgatcgtcttcggggtgctggccggggcgctgctgctgtgcgcgcgtccgggcgagtcgcacgttccgctgccggacacgcgggtaccggtggcggtaccggtggccgtgcgggaacagccgcaggccggggcgcaggcgcacgtcgtctgcgtgtctccgtacgacctgcccggctgctcgccgctcacgcgcgtcaccccgggtgtgctgcccgtgccgccgcccgccgtgaccggtcccatgggcgcgccggcgcccgccgcgacggcctccggggtgtcgcggatccggctctacggggctccgccgcgcgcccccgacctgtatgccctccaggtgctgcggacctgagcggtccggttcggtttcgcgttcatccacccccctcagcagaaggaaccagggcacatggccagcaattccggcaggaccaaccagcacaccgacccgcactcccgccaggcgcgcatagccgagatgcggcgcgccgaccagatccgggagcggcgcaacaaggccatcgccatcacggccgcgtcggccgtcgtcgtcggcctcgtcggcttcggcgcctgggtgctgatcgaccagaagcaggccgagcagcgcaaggaggcggccgcggagaagatccgcaaggaggccgaggagatccgcaagcagccggtcgagggcgagcagctctgggacgtgaagaagctcggccgcaatcacgtcgagaccccggtgaagtacgagatgaacccgccggtcggcggcgaccaccacccccgctggatgaactgcaacggtgacgtctacacgaacccggtgccggaggtgaacgccgtgcactcactggagcacggcgcggtctgggtgacgtacaacgagaaggcccccaaggccgacgtggacaagctcgccgcgaccgtcggcaagaccccgtacacgctgatgagcccggtcaaggagcagaccggcccgatcacgctcagcgcgtggggcaagcagctgaccgtggacagcgcggacgacccgcgggtgtcgcagttcttcacgaagtacgtgcagggcgagcagaccccggagccgggcgcggcctgcacgagcgggctggccggcaagtgagccgcgcgacgggcccggtccgccccgtcccccgtacgtactgggtggcgggcaccgccgtcctgctggccctgctgttcgcggcggccgccacggtcgccgccgcgaacggcggcggttccgccggtcccggcgtgccggcggccggaccccgtacgccggggctgaagtcgccggacgcgggattcgcccgggacatggcggtgcaccaccagcaggcggtggagatgtccttcatcgtgcgcgaccgcacccaggacgagccggtacgcaccctcgcctacgacatcgccaacacccaggccaaccagcggggcatgctgctcggctggctcgacctgtgggggctgccgaaggtggtggccggcgaggcgccgatgtcctggatgggcgcctcgggcggccacggcgggcatgtgggccacggcgccgacgcgggcgccggcgccgccaggcccggcgcgctgatgccgggcatggccaccagggaggagctggaccagctgggcgccgcctcgggccgggacgcggaggtgctcttcctccagctgatgaccgaccaccacaagggcggcgtcgcgatggccgagggctgtgcgcagcagtgcgagaccccggtcgagcgggagctggcgcagggcatggtcgacgcgcagcgctcggagctcaccctgatggcggacatgctgcggcagcgcggagccgcgccgcgcgggtgacgggacacgcccgtacggtggtgagaggcgccctctcacccgtacgggcgtgtgctccgccggtggggacgccgcaccgggcgcgcccgcgcccggtggaacggcgtgctcagtgctcaggaggttcagcgatgaccaccgccgcagacatcatgcaccccggggcccagtggattcccgccaccgagaccctcgaccgggccgcccagctgatggcccggctcaatgtgggcgccctgcccatcagcgacgccgaggagcggctgtgcggcatcatcaccgaccgcgacatcgtcgtgaactgtgtggccaggggccacgacccggagaaggtcacctgtggtgagctggcccagggcactccccgctggatcgacgcgggcgcggacgtcggcgacgtgctggaggagatgcagagccaccagatccgccggctgccggtgatccgggacaagaggctggtgggcatgatcagcgaggccgacctcgcccagcacctctccgacgaccagatggccaccttcgtggagaaggtctacgcgcgggcctgaccctgcccggccgtcgccaggaccgcccgtgccacctggtccgggcggtccagcatgatcaggtgtccggcgggttcggcgacctcgaagcgggcgccgagcaggtcggcgaggtccgcctggcgggccagccagcgcagggccgagcgcccggccgagccgtcgtgggcggcgaggacggtggtgggggcggtcagcgggtgcgtcctgcgcaggtcctgcagctcggcggccatgtccgggtagcgggagttctccagcagggcgccgcgccagacccggccggtgcggtagcagcggcgtacgaggtcccgggcggccgggtcggagccgccggtgcgggagacgcgtacggtggcgcgccggaccggcgcgcccagcgcggccggcagtccggcggcggtcacggcccgcccgagggcgcgggcggccccggtgcgcagcagggcgggcaggaccgtacgcgggtcctcctcgacgctgccgtcgaccaggaccagcgcggcggtgcgccgcgggtacaggcgggcgaaggcctcggcgtggaatccggcgatggagtgcccgacgacggtgacgggtccggccgcctcggcgccgagccccagcgcgtccagcagaccggcgatgcggtgggcctccccggcggtcgtgggcggctcggcggcggggccgctgaggccgtgtccggggcggtcgaagcggacgacggtgcggcccgcggcgacgagcggtgcgacgaccgggtcccagtcgaaccaggccatggcgagtccggcgctgaggacgcacacgggtccccggccttcgacgacgacgtgcagcggaaccccgtcgccgccgtggccgccgtcgaagccgtcgaagccgtggctgccgtggccgccgtggacgcggacgaaccggccggtggcgtcgctcatgtacggccttccttgtggacggagtgggcgagcaggcccagccagagcgcgaccaggagcacctggagccgctggccggcgccgagggcccaggtgccgtgcccggcggtgaacatcgcgatcgcggacagggtccagacggtggcgagcagttcgagggcgacgagggcggggccgtagcgggcgagcggggcgaaccagccgtagcggcgggcggcgaccgtgagggccaccaggccgacgagggccccggtcatggcgaggctgctgctgacggcgtgggcctgatgggtggcgggtaccagtcccgcggtctcccgggcggcgcattcggggtccacggtgggccggcagctcagcggcagccaggcgtcggcggcggtggccgcgccgaagagggtgaccccggcccagccgatgaccgcccaggagcggcgggactccgcgtacttcagcagccggaagagcgccaggagcccgccgcagaaggcgagcagccctgcggtgaagtcggtggcccggaagaggccaccgagcggctggtcctgggcggcgagctcgctgacgtacgtctcgatggggttcaggcccgtggagaggacgacttcgagcacccacgcggtgtaggcggccgcggcgagaccgatcagcgtggcgaccggccaggcggtccgcggcgagagtccatgtggggacatagtgtgactaatcctaagcagactcggggtcggtcctgcgatcggatacccacccccggtagggttcccgtcatgacgcgcagtgctcggcgagccgccccgggggcccggttgctgctgctcgccgcgctgttgctgggcatcgtcaccatgcacaccctggggcatccgaccgagtcccacgccgtgcaagacgtgtccccggcccactccgttgcctcggcggggccggctgccccggccgggcacggtggcacccgccacactccggccccggccgccgacgcaccctcccccgcggtcccctcgtggggtcacgcgatgcccgcgaccgagatggaccccacgtcggtctgcctcgccgtgctcgcggggctcgtcgtgctgctcgtcggcagcggccggaccggatcccgacgcgccgcgccgctcgggggcgcggcccgcatagcggtccggtccggcggcggtccggacccaccctcgccccgcgagctcctcatccggctggcggtcctgcgggtataggccggcgcagccgccgcccccgcatgcccgcgcatgcgccggggtggcgccgaaccgtgcccatgtatccgtgacaccacacccatgaggtgctcccatgcgctctcttcccacccgccgcaccgtcatcggcgcgtccgcggccgtcctcggctccgggctgctcgccgcctgctccggatcctccggggccggcggttccgcaggttccgccggcggccacggctcgatgaaccacggcggttccgccgccgacgtgcccgaggggtacgtggacccggccggacccgaggtccaggccgccgaggccgcccgcaaggccaccggcccgctcaccgaggtcaaggtgaccgccaccgccaccccgctcgacctcggcgccggcatcaccgtccgctcctgggcgtacggggacaagctgccgggccaggaggtccgggccaccgcgggcggcacgctcgccctcaccctggccaacaacctccccgaggccacctccctgcactggcacggcctcgcactgcgcaacgacatggacggggtcccggggctgacccagcgggacatcgccccgggcgggtccttcccgtacaagttcgccgtccccaccccggggacgtactggttccacccgcacaccggcgtccagcaggaccgcggcctgtacgccccgctcgtcgtcgaggaccccaaggagcccctctcctacgacaaggagtgggtggtcgtcctggacgactggatcgacggggtggacggcgccaccccggacgccgtcctcgccgagctccgcaagggcatgaacggcagcggaggagcccacgctgcccatggcgggagcgccgccccctcccccggcggcaccggcaagaagcgctcctacgtcgcgatgggcggccacagcgactacctcggcggagacgccggcgacgtcgtctacccgtactacctggtcaacgggcgggtggcggacgacccttcggtcttcaccgccaagcccggcgaccggatccggctgcgtgtcatcaacgccggcggggacaccgccttccggatcgccctcggcgaccacgagctgacggtcacccacaccgacggctacccggtggagcagacgaatacggggtcgctgctgctgggcatgggcgagcggtacgacgtcctggtcaccgccaaggacggggtgttccccctcaccgcgctggccgagggcaaggagggctcggcgctcgcggtgctgcgcaccgggtcggggacggcgccgacggccgcgacccggccggccgaactggacgcgccgccgctgatggcggacgcgctgaaggccgccgaaccggtggcgctggccccgcgcgacccggaccggacggtgcagatccggctcaccggcaacatgacctcgtacaactgggccttcgacggcaagccgtacacgcccgaccagcggcatccggtgagggcgggcgagcgggtccggctggagttcgccaacgccacgcccatgtggcacccgctgcacctgcacgggcacaccttcgcgctgggcgggcaggagggcggggtgcgcaaggacaccgcgatcctcctgccggggcgcaggctgacggtggacttcgacgcggacaaccccgggctgtggatgacgcactgccacaacgtctaccactcggagtccgggatgatgacggtgctcggctaccagctgtaggccacggccgtctgcccgcccggctcccgtaccggggcggggcgggcagacgcgcaggcgggcagggggtgcggagcggcgggaattggggtgggtccatggcgcggacatggcacccttgcggagatcacgactgtcgcgacagaaggacgaccccgccggtatgagcaccccgccgaacccgcccagcactcccgccggtccgccgaccgagccggcgggcaccccgacagcagagacggaacccataccggcacccgcaccgacgctctcgctggagaagaccccggccgaaccggcggacgcccccacagccgagacggaacccatacccgcgcccgcacccacgctctcgctctcgctggagaagaccccggccgaaccggcggacacccccacagccgagaccgaacccatacccgcgcccgcacccacgctctcgctggagaagacgccgaccgagccggcgacccccgaggcgaccgggacccccgaggcacccgagagccctgtgacgcccgtggcccccgtggctcccgcggcggccaccccgcagccggctcccgccgcatcggccttcgccccgccgatgcccgctccggctgccactcagacccatgcaaccccgggcttcggtgcccccggcgcccccggccacacgtggcccgagtccgccccccgcttccccggagccccgtaccccgggtacccgcaggcggccccgaggagcaacggcctggccgtcgccgccctcgtcaccggcgggttcggcatcctcctgggcgtcatcccgttcctgttctgggccggcaccctgatcgccgccgtcggcgtgggcctcggcatcggcgcgatcgtgcgcgccaacaagggcgccccgaacaagtcgatggccgtcgtcggcaccgtgctctccgtgctcggcctgctcgcctcggtcggcggattcgccctcaccgtcatggtcgtcgacaaggccgacgacctggaccggcacgccggggaggagtggggtgcggaccggcgccgtcccagcaccgagccctggccgtcgaagtccccttcgcccacccaggtcccgggcctgaccagcgcgctgccgttcggcgagaccttcacctacccgaacggcgtccaggtgagcctctcggtcccgaccatgtacaagccgaccaactcgtactcccgcgagcacgtcaagaacgcggtccagctcaccgtcaccatcaccaacggctccagcacgccgcacgaggtgatctacgccatgcccaacgtccgtgacgaccagggcatgaccgccgagatggtcttcgacggcggcaacgtgccgaagatgatccggggctccatcctgccgggtgaaaccgccaccggggtggtggcgttcgaggtccccaagggcaccaggagcatcaccgcggacatctccgccggggtcatgctcgacgacgtgaagtacgcgggcccgatcggctgacgggacgtcacaacgcggtgaacaggcggagtccaggacatcgcgtcagaaagacgattacactgggcccgtgcctcaacttcgactcgctctgaatcagatcgactcgcacgtcggcgacatcgccgccaacgccgactcggtcgtccactggacccggcactccgccgagcagggtgcccacctggtggcgttcccggagatgatgctgaccgggtatcccgtcgaggacctcgccctgcgcggctccttcgtggaggcctcccgcaccgcgctgcgcgagctcgcgcagcggctggcggccgagggcctcggcgagctgccggtcgtcgtcggctacctcgaccgcaccgagcgggccacgccccgcctgggccgcccggccggctcccccgagaacgcggcggccgtgctgcaccgcgggcaggtcgtcctgcgcttcgccaagcaccacctccccaactacggggtgttcgacgagttccggtacttcgtaccgggccagacgcagccggtgatccgggtcggcggggtcgatgtggccctggccatctgcgaggacctgtggcaggagggcggccgggtcccggccacccgctccgccggggccgggctgctgatctccgtgaacgcctccccgtacgagcgcaacaaggacgacctgcgcctcgaactggtccagaagcgggcccaggaggccggctgcaccctcgcctacctggcgatgatcggcggccaggacgagctggtcttcgacggcgactcgatcgtcgtcgacgccggcgggcaggtcatcgcccgcgccccgcagttctccgagggctgcgtcctggtcgacctcgacctgccggccgcacgcgccgacgcgcccgagggcgtggtggacgacggcctgcgcatcgagcgcgtgatcctctccgaggaacccgtggagccgtacgagccggtcgtcaccggcggttacgccgaccggctcaacgacgacgaggaggtctacgacgccctggtcgtggggctgcgcgcctatgtcaggaagaacgggttccgctccgtcctgatcgggctctccggcggcatcgactccgcgctcgtcgccgccatcgcctgcgacgcgatcggcgcgcagaacgtgtacggcgtctcgatgccctcgaagtactcctcggaccactcccggagtgacgcggccggcctcgccgagcgcaccgggctgaacttccggaccgtctccatcgagccgatgttcgacgcctacatgggttcgctcggcctgaccggcctggccgaggagaacctccagtcccggctgcgcggcaccctgctgatggcgctgtccaaccaggagggccacatcgtgctggccccgggcaacaagtcggagctggccgtcggctactccaccctgtacggcgactcggtgggcgcgtacggcccgatcaaggacgtctacaagtcggacgtcttccggctcgcggagtaccgcaaccgggccgccgccgagcggggcgaggtcccgccgatcccggagaactcgatcgtgaagccgccgagcgccgagctgcgcccgggccaggtggacacggactcgctgccggactacccggtgctcgacgcgatcctggccatgtacgtggaccgcgaccagggcctggacgcgatcgtggccgcgggcttcgatgcggagctggtcgccaggaccctgcggatggtggacacggcggagtacaagcgccgccagtacccgccgggcacgaagatctccgcgaagggcttcggcaaggaccgccggctgcccatcacgaacggctggcgcgagcgggcgtagacacggcgcggccccggcggctctccgaggagggccgccggggccttcgcgccgccgcgtccgtcagggcttcacggtgacccgggcggcgacgggaaggtggtcgctgcccgtgcggggcagggtccaggaggcctccggccggatgccgcggaccatgatctggtcgatccgggccatcgggaactgcgccggccagctgaagccgaagccgtcgccggccgcgccctgggtggagcgcatctgcgaggtgacctcggacagggcgcggtcgttcatcgttccgttgaggtcgccgagcaggatgaccttcttcagcggttcggcggcgagggcggcgcccagcgcgtcggcgctgtcgtcgcgctgattggcggtgaaaccggcgtgcagcttgacccggacggagggcaggtgggcgacgaacgcggcgacctggccctggggggtggtgacggtggcgcgcatggcccgggtccagcccatccggatgtccacgggcgcgctcgcgctgagcgggtacctgctccacaggccgacggtgccctcgaccgagtggtacttgtacgtggccgcgagggccttctcgtagacggggacggcgctgcccttgagctcggtcagggccaggatgtcggccccggaccgggccaccgactcggcggtgccctgcgggtcggggttgtcggcgtccacgttgtgggtggccaccaccaggttgccgccggagccggacttgtcgctgaccaggccgccgaagaggttcgcccagaccgcggccgtcagcagtatcgccaggagcgcggtggcggacctccggtagacggccccggccagcaggagcgggacggccaggcccagccagggcaggaaggtctcggtgaggctgccgaggttgcccacctggttgggcagctccgcgtggaagatcatgacgagcgagatcagcacggcgatcgcggtgaggatccagccgcgccgccagatccccggatccttgctcagtgcggtcagccggcgccggaggcgggttccggagggctcgggctccgagccgccgttccccgactccgtcatgtacgcctgtgccataccactgccctcactgccgtgctcgcgctccgtccccgccccttgaccctaggcgatgaaccggagccttccgtgccgtacgtcacgaccgtcggtcacggtcgtgtgtcccggaggacgaacggccgtacgcagggggttccggttgtcacgaaacgcgcacattggatcccgtggccaggctcgcaccacggggcacttccgcctttgcccgcgcggatgccaccatggggggtgagtccggggacgtcgtaagggcgcctcgagatgacacaaggagcagttgcaatgacgcctgccgtttcgcctgcccgcgaacccgccgcagcatctccgtcggccgcacccaccctgtacggaggcacgggcacccggcgcatcaccgtccgcgacctgaccctcgccaaggaacgcggcgagaagtggccgatgctcacggcctacgacgcgatgaccgcgtccgtcttcgacgaggccggcatcccggtcgtcctcgtcggcgactccatgggcaattgccacctcggctacgactccaccgtcccggtgacgatggaccagatgaccatgctctcggcggccgtcgtgcgcggcacgagccgtgcgctggtcatcggcgacatgccgttcggctcgtaccaggaaggcgccgtgcaggccctgcgcagcgccacccgtctcgtcaaggaggccggggtcggtgcggtgaagctggagggcggcgagcgctcgctggcccagaccgagctgatcgtccaggccggtattcccgtcatgtcccacctgggcctgaccccgcagtccgtcaacgcgatgggctaccgggtgcagggccgcggcgacgaggccgcgcaccagctgctgcgcgacgcgaaggcggcgcaggacgcgggcgcgttcgcggtggtgctggagctcgtgccggccgagctggccgccgaggtcacccggtccctgcacatcccgacggtcggcatcggcgcgggcgccgagtgcgacgcgcaggtactggtgtggaccgacatgatgggcctgaccggcgggaagatgccgaagttcgtcaagcagtacgcgaagctccgcgagacgatgaccggcgcggcgagggccttcgccgaggacgtggtcggcgggacgttcccgcaggcggagcacgccttccactgatcgcgcacgaccgctcgggcagcccgccgacctcgtgtcggcgggctgtcgtacgtctgtcgtatgtttgtcggtcggctgtcggtgctttgtcagtggtgcctgctcccataagggcatgacgcgaaacgacaacaagcccaacgccgtggaggtacgggggctggtcaagcactacggcgagaccaaggccctcgacggtgtcgacctggatgtccgggagggcacggtcctcggggtcctcggccccaacggcgccggcaagacgacgctggtccgctgcctctccaccctgatcgtcccggactccggcaccgcggtcgtcgcgggctacgacgtggtccgccagccgcggcagctgcgccgcacgatcggcctcaccggccagtacgcctcggtcgacgagaagctctccggctgggagaacctctacatgatcgggcggctgctcgacctctcccgcaaggacgcccgccgtcgcgcggacgagatgctggagcggttctccctgaccgaggcggccaagaaggccgtcatgaactactccggcggtatgcgccgccggctcgacctcgccgcctccctgatcggcaacccggccgtgctctacctggacgagccgaccaccggtctcgacccccgcacccgcaacgaggtgtgggacgaggtccagcgcctggtcgccgagggcgccaccgtgctcctcaccacccagtacatggaggaggccgagcagctcgccagcgagctgacggtcatcgaccgcggcaaggtcatcgccaacggcaaggtcgacgagctgaaggcgcgcgtcggcggccgcaccctgaagatccgccccgtggccgcctcggacctgccgggcatggcccgcgcgctggccgaggccggactggacggcgtggccggcagccaggccgtaccggacgagggcgtcctgctggtcccgatcctgagcgacgagcagctgacggccgtcgtcggcctgctggccacccgcgggtacgcgatcgccgacctcggcacctacctgcccagcctcgacgaggtgttcctggccatcaccggccagaagcccacgctcgtcgaggactccgtccccaccgagaagaccgaggaggtcgcggcatgagcaccgtaaccacgacgaagcccgcgcccacggcgcccggtccggccccggtggccgacacgcacggcgagggccggatcggtctgcgcggcaacctgcggcacatcggcgccctggtgcgccgcaacgccctgcagatcaagcaggatcccgagtcgatgttcgacgtcgtgttcatgccgatcatcttcacgctgctgttcgtgttcgtcttcggcggcgcgatctccggcaagggcaaccagtcggactacgtcaactacgtggtcccgggtctcatggccatgatgggcatgaacatcgccatgggtgtcggcaccggggtcaacgacgacttcaagaagggcgtgatggaccggttccggtccatgccgatcgcccggtcgtcggtgctcatcgccaagatcctggtcgagctcggccggatgatggtcgccatcgcgatcctgctcgcggtgggcttcctgctcggtctgtcgatcaagggcccggtgctggggctgttcctctccatcggtctgtcggccgtcttcggcgcctcactgatgtggatcttcgtcctgctcggtctcaccatgaagaccccgcaggccgtccagggcatggcgatgatggtcctgatgccgctgcagttcggcagctcgatcttcgccccgccgaccacgatgccgggctggctgcagtccttcacggactacaacccgctgtcgaacctggccgacgcggcccgctcgctgatcaacggcaccccggtcggcgactcggtgtggatgacgctgatctggtcgctggccatcacggcggtcaccatgccgctcgcggtgcggaagttccgccagaagacctgacccgcggaccgatccgttcggatcgcgtcccggacggacaccggccgggggccgggtcagatgagggcggtggcctcctccggggagaggccaccgccttcggcgtacgccttctcgtaggcggcgtcgcccagtgccgcccgggccagctcctgcgcccgggcgtggtcctcgcgctccatcgtcaccgggaagtgcccgggcggcagcagcgcccggtaggcgcccagcagccgggccgcgtcgtactcccggcgcgggccgccgagcgagaccagcgagagcgccgcggacatcatgtagaccgccggcatctgcggggccaccatccgcgccatcgggtccatggcggtgtccatggcctggcgcagccgggcgagggcctcctcgtacagcccctgccggttgtccagccaggccatcgtgccgagcaggaagccgtcgaagatggcgaacgcgccgaaggcgaactcgtcccgcaggagctgcagctggtcgcgtgcctcggagatccgtcccgtgcgcccgaggacgcccgcgaggaacatccgggcggcgggcatggcctcgttgccgtaccgctgggccttggcggtgatctccgtgaggatcgactcggcctcctcgatccggccgtcctcggccagcgtcccggccatccgtacgcgcagcacggtcacctgggccatcgcgccgaggcgttcggcgtaggcgaccgcctcacggtagtcgcgggtggccgccgtgaactcgccgcgcttctcccgggcctcggcgcgggcggccagtgcctcggcgcagccccaggcatccccgagctcgcggaagagcgcgaggctctcgtcggcgtcgcgcgaggcgtccccggcccagtcggcccggttggcgaggatgttggcgcgcagctggagcgcggaggccagctcccagcggtagccgagctcgcgggcggtcgcgacgctcgcgtcgacgaccctctggagcagtccggggtcgcccgcgatcatgacggcgtagatccacagggaggcgggggtccggcaggtctgcgggagtcccggccggtaggtggcgaggaccccgtcgatgagggcgcggaccgagggggtgttccaggtctcgttggtctggtcgcgggaggccagcaggaccaggtgcagggcacgccagccctcggcgagcgtttcgccggagtagggcggcggcgtgtcgacgagccgttcgtggacgggctcggcggggacccagggcggctcgaaggggttggagcccagggtggcggtggcctcggcccagtgccgggactcggagcgcaggtcgtgcatgtgccagtaccagccgagcgagtggaccaggcacagcgcttcgtcggcgtcgcggacggcgatggcccggcgcagggcggtacgcaggttctcgtactcgtcggcgagccggtcggtggccgcccgctggccgtggccgcgcagcaggggctcggtggtgcgggcgagttcgcggtagtggacgaggtggcggtgctcggtggcctcgcggtcgccggcggcctcggcgaggcgctcggcggcgtactcgccgaccgtctccaggaggcggtagcgcatgccggaaccgttgcgtccgggggtggccacgacgagggacttgtcgacgagggagccgaggaggtcggcggcgtcgtagcgggcggggtcgccggggtcggcgcagacgtcctcggcggcggcgaggtcgcagccgccggcgaagacggacaggcggcgcaggacggtgcgttcggcctcgtcgagcaggtcccaggaccagtcgaccacggcgcgcagggtctgctggcggggcaggaccgtacgggcgccgctggtcagaagccggaaacggtcgtcgaggcggtcggcgatctggcgcagggagagcagccgcaggcgggcggcggccagttcgagggccagcggcagcccgtcgaggcggcggcagatctcggcggcggcggtcgggtcctcctcgacggtgaacccggcgcgggccgcggccccgcggtcgccgagcagccgcagcgcgatggggtcgggcagcggttccaccgggcgcagggactcccccgggacgccgaggggttcacggctggtggccaggatccgtacgccggggcagtgcgtcaggagccgctccgcgagggcggcggccgcgccgacgacgtgctcgcagttgtcgagcagcagcaggagccggcggcgtgcgcagtgctcggcgagccggtcgagggggtcgtccccggcgcgttcggtgagggcccgcagctcctcggcggcagcgccgcgcagcttggtctcccgggccccgagcgcggcgagggtggcctcggcgaggtcctccgggtctccgggcccgtcgatgggggcgagttcgacgagccacaccccgtcgggccaggcgctctcgtcctgggcctcggcggcctcctgggacagccgcgtcttgcccgcgccgccgggcccgaggagcgtgacgaggcgggcccgcgcgaggtcctccccgatgacgcggatgtcgtcctcgcgaccgacgaaggtggtcaggcgcgcccgcagattgccggcggaggcggccgggacgggggcggccgcgggggcggcttcgacgggggcggccggggacgcgtcggcggccggggacctttcggcggccggggacctttcggcgacggccgcggcggcggccggcggccgcccggccggggtcagcagttcggcgtggagggcccgcagctccggccccgggtccgcgcccagccggtcggccagctcccggcggacggtgtcgtaggcggccagcgcctccgccgtgcgccccgaggcgcgcagggccttgatgcgcaggatgtgcagcggctcgtccagcggctgctgcgcgcacagcgcggtcagctcgggcagggaccgctccgcctcgcccagctccagggccgccgcgagcctcccccggcgcgcgtccatccgtacggcctcccagcgcgcggcctccgcggccgggtccggcaggtcggcgagggccggtccgcgccacagggcgagggcctcctcgtacagggccgccgcgtcggccgggtccggtgaccgggcgccgtcgcggaccagccgctcgaagcggtacaggtcgacgtcctcccgctcggcggccagctggtagccgccctccgcggaccgcacggcggtgtgcccgagcgcccgccgcagccgggcgacgagcgcctgcagggcggccaccgcgtcggccggcgggtcgccgtcccacacctcggcgacgagcagccgggtgggcaccacccgtcccggccgcagcgcgagcgcggtcaggagcgcccgcaggcgcgctccgccgacggccacgggggtcccgtcgtcgtggatggcctgggcggtaccgaggatcgcgtaatgcaccggcccattgtcgcctgcacccggccccggacccgcaccgttttccgccgtgcccgcgggataggtttccccgcatgggtcatcagggcagccgcggagagcggcagatcagttcggtattcgtcggcatcgtcgcgatcatggccgtcacgggctgggcggtgtggaccgggtacgcggcgagcgccggactcgccgtgttcctcttcgtgacgtcggcgtggatcgtctccctgtgcctgcacgagtacgcgcacgcccgcaccgccctgcacggcggtgacctcacggtgggcgcaaagggctatctgacactgaatccactcaaatacacgcacgccctgctcagcatcgtgctgccggtggtcttcgtgatcctgggcggcatcggcctgcccggcggcgcggtgttcatcgagcgcaaccggatccagggccgctggaagcacagcctcatctcggcggcgggcccgctgaccaacgcggccttcgcggtggtgtgcacggccccgttctggctggacgccctcgaaggggtgccgctggcgttccgtttcgcgctcgccttcctcgccctgctgcaggtcacggcggcgatcttgaacttcctgccggttccgggcctcgacggctacggggtcatcgagccctggctgtcgtaccgggtgcgccgcgaggtggagccgctggcgcagttcggcctgatcgccgtcttcgcgctgctgtgggtcccggccgtcaacacgttcttcttcgacgtggtctacggcctgctggactccctcggcgtgaccgggacggaggcgtcctgcggacgcgagctgtacaccttctggcgcgacgcgtcgggcttctgcccgaccccgcaggactgacctagatcgcgttgcgcgcggcggaggccttctcggccttcgccttgcgcaggtagtaccaggccatgttggacgtgaggccggccagcagcacccagacgatcccgaggaagctgccctcgacgaaggcgacgacggccgcgaccaccgcacaggcgcagacgacaatggcgaagacggcaaggcggggcatgggaagagctcctcggaaacactgaacggggtcgagcccctccagtgtcccccatgccccgcagtgctgccgtaaggacgccgtcgatccatccgggtgacgtgacgtcgggtgcggtgtgcgggccgggtcagaggtccgtgacgcgcaggcccgcgtgggccttgtagcggcggttggtggagatcaggttggccaccagcgactcgacctggtgggcgttgcgcaggcggcccgcgaagacgccccgcatgcccgggatacgggcggccagggcctggacgatgtccgtgtcggcgcggacctcgccgaggaccatcacgtcggtgtcgatctcgtcgatcgactcgtcctggagcaggacggccgagaggtggtggaaggcggcggtgacgcgggagtccgggagcagggcggcggcctgctgggcggcgctgccctcttcgacctggagggcgtaggcgccctgcttgtcgaagccgagcgggttcacgcagtccaccacgagcttgcccgcgaggtcctcgcgcagcgcttcgagggtcttggcgtggccctcccacggcaccgcgatgatgacgatgtcgctgcggcgcgcgcactcggcgttgtccgcgccctccacgccgaggcccagctcgtcggccgcggtctgcgcgcggtccgcggcgcgggagccgatgatcaccttctggccggccctggcgagccggtaggccaggccccggccctggtcaccggtgccgccgaggacgccgacgacgaggccggacacgtccggcagctcccacgggtccttgaccggcggcttctgcgtgttgtctgaggaagtcatgggggcgagcgtactgccgggtagcccacagtcgaaggggagggaaccgctcccccgtgtcgtccgcatggtgcaggatgccgatatggacgccgtgagggtcgcgctgctgcgcgaggtgctcgccggtacgcagtggccgggtgccgcgcgccgcttcgccggatcgctgcgccggtccgtggtgccggccggcggtcacctgctgctggtggggaccgagggctacgagccctggcatctggccgcgcacctggtcgacgaggccgcctggtcgggccggccggagctcgcgcccacgctcgtacgccaccgcgtacagcccggggagccgccgcacctgtcggtcgggctgggccggctggcggcggcccggcgcgggcacacgctgctggtggtggcgcccgggacgccgggtgcggggctgctggagcgcgtccacgacgcccggcgcgcgggggcgaccgtactgtccctggacggcggggaccgggagctgggcgccctcgcccacgacgcgctgtcggtaccggcaggggcggcgggccgggacgacgggatggatctggacaccgtgcagcacctggtcagcgcggcggccggggagaacggcatgccggcgcagcggggcccgcgccggttccgggaccggctggcgcggctggccgatcagctgaccgcgccgccgcccagccgctggtagggactacgccccgcccgtaccggccgtaccctcttcgtcctcgcgggtcctgtcgttccacttggggtcgttctgccattcgaggttgcgttcctgcgccgtctccatggcgtggttcgcctcctccggggttccgtacggcccgaaccggtccttggccggacagtcggggccttcctcgaccttcttgtggaccaggcagtagtaccactcgccgggtttgcccacctgacgcttcttgaacagggccatcgtcgtcgggctcctctcgtaccgctccgtcccgccatgctgccccatccccgctggatacactcgctcgcatgtctggccagtcgctgctcgtaccaggcgagctctctcccgtccgttccgttcccggaaacatccgtcggcccgagtacgtgggcaagcccgcacccactccgtacaccggaccggaggtgcagacggccgagaccatcgaggccatgcgcatcgccggccggatcgccgcccaggcgatggaggaggccgcgaagctgatcgcgccgggggtgaccaccgacgagctcgaccgggtcgcccacgcgtacatgtgcgaccacggggcctacccctcgacgctcggctaccggggcttcccgaagtcgctgtgttcctccgtgaacgaggtcatctgccacggaatccccgattccaccgtcctgcgcgacggcgacatcgtgaacctcgacgtgaccgcgtacatcggcggcgtgcacggcgacaacaacgcgacgtacctgtgcggggaggtggacgaggagtcgcggctgctggtggaacgcacccgggaggcgctgaaccgggccatcaaggccgtcaagccgggccgtcagatcaacatcatcggccgggtcatcgagtcgtacgcgaagcgcttcggttacggcgtggtccgggacttcaccgggcacggcatcaactcgtccttccactccggtctgatcgtcccgcactacgacagcccgcacgccaccacggtcatcgagcccggcatgaccttcacgatcgagccgatgctgaccctgggcacccacgagtacgacatgtgggaggacggctggacggtcgtcacgaaggaccgcaagcggaccgcgcagttcgagcacacgctggtggtcacggactccggcgcggagatcctgaccctgccgtaggcgttccggcgctctccgcgcgcacacgaccgggcccggtgcacctgtgcaccgggcccggtcgtgtaccaccccttacgcgctgagcgggaactgctcgcccagctcgcggaagaccgcgccgttgaagtcgaaggcgcgcttgcactcgtcgatgatgcgctgcttctccaggtcgtccgcggctatggcgtccagcagctcgcggtaggtccgcttgaaggcggccgggttggagatgtccgagaagacgtagaaccggacgccgtcgcccttgcgctcgaagccccaggtgcgctccgccttgtcgcggatgatctggccgccggagaggtcgcccaggtagcgggtgtagtggtgggccacgtacccgcccggccactcggcggcgcactgcgccacgcgctcggcgtaggcgcgcgtcgcgggcagggccgccacactctcgcgccagtccgggcccaccaggtgggcgaggtcgcgctcgatctcgcccacgcgcatcagctcgggccggatgaacgggcctgccaccgggtcgtccttgagggattcggccgcgtcctccagggcccggtacacgaaccacagctgctcggtgtagcgcgtgtaggcgtccacgccgagccgcccacccagcaggtcgctcatgaaggtcgacgtctccgcctcggtgtgctgctcgtgcgaggcgacgcggatgaccgtagagaaggcgtccaaggcggacctccaggaagaggaaacaggcgcggcgggccgtgccgccatgcccgatcttcctacttaggtttgcctaagtcaatgagttcccgacgcattgtcggtaaaaaatccggcgctgcgcaccccgtgtcagccgcccgagaacccccagagcgtgaggatcgtgacgaggaccaggtgggggtagaagaaggccaggaggcagcctgcgctcccgaccgcgagccgccgcccgcgctgcgcgtcggtccgcggcgggatccaggtgaaggccaccatcgccaccgggagggcgtagaaccagaccagcccgggcgggaagccgggcaggtaggaggtcgcccggccgcaccacacggccaccgggcccagcacggtgaagagcgccgccaccggcagccattgccgccgctcgtcggggcggcgggtcaccgaagtcttcgtcatgccgccattgcaccgcgccggccggtggcggcatcagcgccggcgtactcacttcccctgcgcgaaatacccagaggcggtgggtcagatccggtccgggtccgggtgagggctcggggcgaagcggacgcggccgccgatctccaccgtgccgtccgggccgggggcggtgaggatctgggagcctgcgccctgggtgatgttcagggcacggttcagctgggccgtcagcaggatcgcggccgagcccgtggcctcgtcctcggtgatgatcccgtcggggcggcgcggaaagccccgggcccgtacgcggccggcggcctcgtcctcccaggcccaggcgtacagccagccctcgccgggcggcggggcgggcagcgcctcgacctcggcgacggatgcgtactgctcggtgcgcttgccctcgacccactcggggcgggccgtgatccaggtgaactccccgtcgtcccgggcccatacggatccggcgggcggctggagctcctctatgtccagcaaccacgcggccccgaccagcggatgccccgcgaaggacatgcgcgtgccgggggtgcggatgtcgacgaccccgcgctcggggtcgtcgacgaacaccgtctcgctgtagccgagttcggcggccagcgcctgccgtgacgcatcgtcggggcaggtccggccgtcgcgtacgacgccgagcaggttgccgaagcggccgtcacccgcgcagaagaccttcaacacgtcgagatcgttcacgcgggaattcaagcacggctcagacctgggacgtacgccgcctgcgcgcgaggtacaccgcgcccgcgccggccgcgatcaccacgccggaggtggtgagcagggccccggccgggatctcggcgccggtgtcggcgaggttgccgccgacggcggagccgccggtggaggagccgccgccgaccgtgccgcccgtggtgccgccggttccgccggcggcgcctccgttcgagccgcccgtcgtaccgccggcgctcggcagggtggcgtccttgtccaccgccacggcgaaggtgagcggatccatcgggtcgcccgccttgtacatggacccggtggtggcgttggcgaaggcggccgcgccctcggcggtgaaggccgccgggaccgcgttcagcgccaggacgccgttcctggtcttgtagtcggtcttcgacaggtcgagcgtggcgaagcgaaggcccgtcttggcgccggaggcgttcttgacgtccacgtagagggtgccggtcttgccggtggcctcgacgcgcgggtcgccgaaggtcatgtcgatgccgtgggccgcgtactggaagcggaggttgccctggaaggaggcgttcagcttctgcttcttgacgtccaggtcgcccttgccgaaggcgaagtcgaaggtgtcgccgttcttggcggcgccgccggccggggtgatcgagcccgcgctcagcacgtatgtgcggaaggactccttcacaccccacgtcagcctgccgctgagcaccttctgcgtgtcgtcggccggaggcgtcgggttcttggtggtgttctccggggtgggctcgggggcgggcttctcgaactgcagcttcgcggtgagcgggtcgcccgccttgtccttgtagcccgggtagccgagggcgtccgcggcttccgcggtgagcgtggtccccaggttgtccatcgtctggccggcgaaggccacggcggccagcggcacgtcctgggtggtcgcgccgcccttggtgacgtccgcggtgagcttcttggtcccggtgtcgatacggaagtccgagagcttgacctcgaagccgtggccggccggcggggcgggcgaggagaaggtgacgctgcccttgaaggcggccttcaccacgtgcccgttggccggctcgtacgcaccggtcggcgcgccgaagcgcagggtgccgtccttgttctgctcggccccgtccgcgacggtgatggtgcccttggccatgccggtcacgtaggcgcggtagctggcgagcacaccccagtcgagggtgccgccggtgatcttcatcggttcggtgggcgggccgcccgcggcggtggcgggcagggcgaaggcggtggcggcgagcgccgcggcggtcaggaccgcggccgcgagggagatcgggcgtcggatggacgacatgactgggtactcctgaaggaccagggggacggggaaggggagggggagggggtgctaccggggcgcgtcggtcggcgccggcgaggcagcggctgccgtacgccgcttgcgcacggccaggaaggcgccgccgccggccaggaccaggacggccacggcgagggcgatgaagagcccggtgtccgaggactcctcggccttcgcggcgggagcggacccggcggacggcgacgcggccgcgggggcggcgggggcgggcgaggccgtcgaacccaggtcgggcagggcgggcagccgggcggtggagtccagggcgacggcgagcgagacggggtccatctcggtgccggccttgtacatggagttgaaggcctgggagccgccctcggtgagggtggccggggcttcggtcagggcggccagtttgccctcggtcttcagacccgcggcgtcgaactccacgagcgggacggcgttcttcgtcgcaccgccggtggtgacgtccgcggacaggattcccttgccgttctccaccttcacgctcatcctgccgagggtgaggtcgaggtgggcgccggtgaaccggacggttccggcgaaggccgcgtcgagcgtgcttttcgccccgtcgaacgagcctttgccctgcgggaagcggaagagcgcgccaccgtcctgggccccctcggcgagggtccacccgccctggccgaccgagccggtgacgtactcgcggaaggtgcggcgcaccccccagtcgacggcggcgtcggcgaaggcgcccggcgcctgcggggtctgcgcggtggcgctcggctgcgcggccggggccgacggcgcgggcgcggcgaccggggcggccttgacgtcggcggtgagcgagacggggtcgagctgggtgccggcgccgtagtacccggcgaaggccttggcgccttccgcggtgagggtggccgggatgttggtgagggacagcgggccggcgccgcccttcatgttgatgccgccgacgccgagcgaggcgaaggcgacctgcgactggtcggtgaccgcgccgctgtccttggccttgctggagacgtccacgtacagggtgcccttgccgccggagatcttgacggtcgggcggctgatggtcatgtccagctcgtggacgccgtcgggcttctggtggccctggaaggacaccccgcccgagtaggaggcctcgaaggtgccggagccggggtcgtaggagccggccgcggagtggaagcggaagaggctgccgccgacggtggcggcaccgctcttcagcttgaaaccgccttttgccaccggacccgtgacataactctggaaggacgatttgatgccccagtcgagacggcccccttgtacggtgcccgcctgcgcggcggtcgccgggagcagggcacccagcagggccgccaacagggcgacggcgaacgtacggacgggtctcgtgggcatgaatgccccctcctcagggctagcaagcaaggttaggctaacctaagctaaccctgaccggatgaacaccccccggtctccagaacctcagtcggacgatcaggacggtgccttcgtgcctacgcccgccgcgtcacaccgcttcccccgcctcgcagttgccgtggcagcactggcactcgcgctgacggcctgcggaggtacggccaccaccccgggctcatccgcccccggcgcagccgcggtccccgaccggctggaaccgctcgcggcgccacagccggccctgccggtcacggtgccctcggccgacggcgcccaggtcacggtcacctccgcggaccgggtcgtcccgctgagcggcagcctcaacgagatcgtccacacgctgggtctcggccggcaggtcgtcgcgagggacatcacggccaccttcgaacaggccgcccggctaccggtggtgacacgtggacacgacgtctccgccgagagcgtcctgtccctgcgtccgaccctcgtcatcgcggagaccaccagcggccccggggaagcgatccagcagatccgcgatgccggcatccccgtcctggtggtgaccccggccaagtccctggacgacgtaccgaggcggatcgacacgatcgccgcggcgctcggcgtcaaggaggccggcgcgcagctcaaccagcgcaccgccgaccggatggccaccgtccgcaaggacatcccggccacctccggcaagaagccccgggtggccttcctctacctgcgcggcaccgcctccgtctacctgctgggcggttcggactccggcgccgcgtcactgctggaggcggccggcgcggtcgacaccggcaaggactccgggctcggcaaggacttcacccccatcaccagcgaggccctggcggccgcggcccccgacgcgatcctcgtcatgtccaagggcctggagtcggtcggcggcatcgacggcctggtgaagatcccgggcgtcgcccagaccccggccggcatggaccgccgcgtggtcacggtcgacgacggcgtcctcctcaactacggcccgcgcaccgaccaggtcctctcctccctggtcacccagctctacggcaaggccgcctgaggtgaccctccacgacccggcagccaaggacctgcccaccaccgacgaaaccgcggcgcgacccacaagcaactccgagccgaccgggagcatttcagcgcgacccacacgtagctccgaggcgaccgggagcgcgccgccgcacccccgcggttccgacggggccgggtgtgtgccggggcgctccccgcagggcgccgaacgcactgccgtcgagctttccgacccctcgtcacgttcggcgtccgaggagacgccccggcgcgcgcccggccccggcggaaccgcccccaccacggcgaagcccgagccgcacaaacccgagcgcgaccgcacccgcacccgcagacccgcactcctcaccaccgccctcgtcgccgccctcgccctcctcgccctgctctccgcaggagtcggcgcctacgacatccccctcgccgacgtcctcgcctccgtccggcaccacctcggcctcggcggcgcccccctcgaccgcgtcggcgagagcgtgctgtggaacgtccgcctcccccgcgtcgtgctcgccctgctcgtcggcgccagcctcggctgcgccggcgcgctcatgcagggcgtcttcggcaaccccctcgccgagcccggcgtcatcggcatctcggccggcgccgccgtcggcgcggtcgccgccatcggcctcggcctcagcttcttcggcaactggacgatcaccgtctgcgcgttcgtcgcgggcctgatcaccgtcagctcggtctacctgctctcccgcaacggcgggaggacggaggtcgtcaccctcattctcaccggcatcgccgtcaacgccttcgccggcgccctcatcggcctgttcgtcttcttcgcggacagcggccaggtcaaccagatcaccttctggcagctcggctccctcgcccaggccacctggcccaaggtcctcgccgtgctgccctgcgccgtcgccggcctgctcgtcgccccgctctactcccgccggctcgatctcctctccctcggcgaacggcccgcccgccacctcggcatcgacgtcgaacggctgcgcctggccctcatcctggtcgtcgcgctgctcaccgcggccgccgtcgccgtcgccggtgtcatcaccttcatcggcctgctcgtcccgcacctgctgcgcatggccaacggccccggccaccgcttcctggtccccggcagcgccctcgccggcgccgtcgtcctggtcgcgggcgacctggccgcccggaccctcgccccgcccgccgagctgcccctcggtgtactgaccgccctgctcggcagcccgttcttcttctggctgctgcgccgcacccgtcgcaagcaaggaggctgggcatgaccggcaggctgtcggggctgctcacgaccgggctcctcacccgcgcgcgcaggaccgtaccggcccggcccgcccccggcgacgccctcgccgaggccgtggacctgcacctgcggctcgggcagcgcgaggtgctcgccgggatcgacctgaccgcccgggccggcgaggtgctggcgctcgtcggcccgaacggcgccggcaagtccacactgctgggcgcgctcgccgccgacctgcccgccgcctccggggtgatccggatcgacggccgcccggtgggcgactggagcgcgccggatctcgcgctgcgccgctccgtactcccccagtcggccgcactgtccttcccctttccggtggaggacgtcgtacggatgggccgcgcgccctgggccggcaccccgctcgccgaggccgacgaggaggcggtggccctcgccatggccgccaccgaggtcacggacttcgccgcgcgccccttctccgccctctccggtggcgagcgggcccgggtcgcgctggcccgcgtactggcccagcgggccccgctgctgctgctcgacgagccgaccgccgccctggacctgcgccatcaggagctcgtgctgcgcatctgccgggagcgggccgcggccggggacgcggtcgtcgtcgtcctgcacgatctggggctggccgccgcctacgcggaccgggcggccgtgctgcacgacgggcggatcgccgcggacggcccgccggccgaggtgttcgagggcgggctgctgagccgggtctaccgccagccggtggaggtgctcccgcacccgcgtaccggggccccgctggtggtccccgtccgggcttgacctccgcttgacctcaccatggcattgccatggaggtctcgtgaccgggccgtgtccggcgcgaggaggtatgagctgaatcacggtacgcgggggtatgggtgaggtaagcctcggttaagttaggtccgcctcatcggcctctccctccacggggcggcccctcacgtccgacgccaggagccccctatgcgccccgctcgcctcaccgtcatcgccgccgcctccgtggcggccgctctgaccgccgtcaccggctgctcccagaagagcgacgcgggcagcgagggtgcgatcaaggtgacggcgtccgacagcgcctgcgaggtctcgaagacggagttcccctccggcaaggtgcagctcgacgtcgagaacaagggctccaaggtcaccgaggtctacgtcctcttcccggacgcccgcatcgtgaccgagcgcgagaacatcggccccggcaccaaggcctccatcaccgccgagatcaaggcgggcgactacgagatcgtctgcaagcccggcatgaagggcgacggcatctcccagaaggtcaaggccaccggccagggcggcggcgacaagcgctcccccgagatggacgccgcggtcgccgcctaccgcgcgtacgtggtccagcaggccgaggagaccctccccaaggcgcaggccttcgcggacgccgtcaaggccggcgacgtcgagggcgcgaagaagctgtacgcgggctcgcgcatcggctgggagcgcaccgagccggtcgccgagtccttcggcgacatcgacccgaaggtcgacgtccgcgaggacggcctggaggccggccaggacccggcgaaggactggacgggctggcaccgtctggagaagtccctgtgggccgacaacaagatcgacgacaacgacaagaagctcgccgacaccctgatcacggacctgaccgactggcagaagaaggtcggccaggcggagatcaccccgacctcgatcgccaacggcgccaaggagctcctggacgaggtcgccaccggcaaggtcaccggcgaggaggagcgctactcgcgcaccgacctcgtcgacttcaaggccaacgtcgagggcgcccagaaggcgtacgagctgctcaagccgatcgcctcgaagaacgacccggagctggtcaagcagctcgacacccagttcacggccctgaacacccttctggacaagtaccgcgccgaccagaccacctacgagttcacctcgtacgacaaggtcggcgagccggagcgcaaggagctctcggacggcgtgaacgcgctcgccgagccgctctccaagctcgccgccgcggtcaccaagtaaccggcagagacggaagcaggcgggagagcatgatgaccgagtcggactcggctgcgcagcagtctccggaagacagtggcgcttccgcgccctcacggcgtgcggtgctgggctggggcggggccgggttcgcgctcggtgccgccgcggccggcggtgccgtcgccgcgttcggcggcggcccggacatggtctcggcggcgtccgccggcgcggccgtgccgttccacggcgagcaccaggccggtatcgcgagcgccgtgcaggaccgcctgcacttcgcggccttcgacgtgaagacgaaggaccgcgaggagctggtcaagctcctcaaggagtggaccgcggcggcccgcctgatgacggccggtctgccggtcggcgacgtccacgagggcctgccggaggccccgcccaccgacacgggcgaggcgctgggcctgaaggcctcccggctcacgctgaccatcggcttcgggccgggcctgttcgccaagggccggttcggcctggagggcaagcgtcccgaggcgctggtggacctggagctcttccccggcgacaacctggacgcggcccgctccgggggcgacctctgcgtccaggcctgcgccgacgacccgcaggtcgccgtgcacgcgatccgccagctggcccgcatcggcttcggccgcaccgcgatgcgctggtcgcagctcggcttcggcaagacctcgtcgaccacgcccgacgagcagaccccgcgcaacatgatgggcttcaaggacggcacccggaacatctccggcaccgacgcggcggccctggacaagcacgtgtgggtcggcgcgggcgacggcagtgactggctgaccggcggctcgtacctggtggcgcgccggatccggatgaacatcgagacctgggaccgcaccccgctccaggagcaggaggacatcttcggccgcgacaagggcgagggtgccccggtcggcaagtccaaggagcgcgacgagccgttcctgaaggcgatgaagccggagtcccacgtccgcctcgcgcacccggacaccaacagcggtgcgacgatcctgcgccgcggctactccttcaccgacggcacggacggactgggccgcctggacgcgggcctgttcttcctcgcctaccagcgcgacatacgcaagggcttcatcccgatccagcgcaacctggccaagtccgacggcctcaacgaatacatccagcacgtgggttcggccgtcttcgccgtcccgccgggcgtccgtgacaaggacgactggtggggccggacgctgttcgcgtagtccccgccggagaggaacaaccgccgtgttcggcaactatctgatcggcctgcgcgaggggctggaggccagcctggtcgtctgcatcctcgtcgcctacctggtgaagaccggccgccgggacgccctgcgtcccgtgtggctgggcatcgcgatcgcctgcgggatctccctcgccttcggcgcgatgctcgaattcggcacccaggagctgaccttcgaggcgcaggagctgctcggcggcaccctgtcgatcatctcggtgggtctggtgacgtggatggtcttctggatgaagcgcaccgcgcggcatctgaaggccgatctgcacggcaagctcgacacggcgctggccatgggcaccggggcgctggtcgccaccgccttcctggccgtcggccgggagggcctggagacggcgctgttcgtgtgggcgtcggtacgggccagcggcgagggttcctcggctccgctgatcggtgtgctgctgggcatcgccacggcgatcctgctcggctacctcttctaccggggcacgctgaagatcaatctggccaagttcttccggtggaccggcgccatgctggtggtcgtggccgcgggcgtgctcgcgtacggggtgcacgacctccaggaggcccgtttcctgggcggcctgggcgacaaggccttcgacatcagcgagacggtcccgccggacagctggtacgggaccctgctcaagggcgtcttcaacttccagcccgaccccaccgtcctgcagctcacggtgtggctgctgtacctggtgcccgtgctgacgctgttcctggtcgaccggggccgtccggcgggcgcgccgaaggtgcggcccgcggactcggactccgcgcccgccagctgagggcgcgggcgggccgctgccgacgacaggctgtggtgagggctttccggcctctcaccacagcctgtcggtgtctccggggtggagcgggacgcggacgcccgtgaaggcggcgcggtcccggccggggccgtccgtgaagaaggccgcgagcaccaccttgtcgaagccggggtggtcggtggccagcggctcctcgggggtcccgcccaccaggaccgtgccgggcagcacttcgaacccggccgcctcgtagaacgccgccaggggccggtcgcagctgaacagcgccaggtccacggccgggtccgccgccagttcggcgcgggccgccgcgaccagccggccgccgagcccgcggccgcgcagctccggccgtgcgacgacggagctgagtccggcggcccggtacgtccggcccgccagcgggaccggcttgtacagcagcgagagcgcggcggccaccgtcccggcgccgtccacgagcagcatcgtgcgcggcgtgagcgccggatcgtgcccgggcgaggatcccggccagaccgcggcctccagctcggcgacctgccgggccggccctgcgggcaggtccgcctcggcgcatccgatcaccctcaacaccgggccgatggattcgctcacgggatgcggacgccctcgccgctcacccgcacccgcgggtcgccttcgcgcagttccaccgtgaggaccccgggccggcccatgtccgcgccctggtggagcgtgaggaccgcgtccgccggaaccaggccgcgctcgcgggcgtacgcgccgaaggcggccgcggcggctcccgtggcggggtcctcgaccacgccgcccaccgggaaggggtcgcggacgtggaactcggccgggccgacccggtgcaccagctggaccgtggtgaggtccaggcgccgcatcagggcctccagccgggcgaagtcgtaggcgaggccggcgagccgggcccgggtgcgggcgccgatcaccaggtgccgggccccggcgtaggcgatcgcgggcgggaacgccgggtccaggtcggcctcgggccagtccagggcggccagtgcttcggcgaggtccgccgcgccgatctcctcggtgtgcggctcgacgctggtgagcgtggcccgcagccggccgtcctcggaggtgacggacaccggtacggtccccgcccgggtggcgaggaggagctcgcacggcccgatccgctcccccagcgcgacggccgtggccacggtcgcgtgcccgcagaaggggacctccgccttggggctgaagtagcgcaccgtgaacgaccggccctcctccccgccgaacccctcgggcggggcggtcaggaaggccgtctcgctgtagccgagcccggcggcgatctccagcatggcgcgctcgtccaggccggcggcgtcgagcacgaccccggcggggttgccgccgtccgggtcgtgggagaaggcggtgtagcgcagtacctcgatgtcggtcatgcggccatgatcgtccgcgtcccctcggcctggcaatgcggttccggcggcggatcccgccgctgtccccgctgtccgcccgcggctcagccgcggccgatgtagggcatcgaggtcgccatcaccgtcgcgaactgcacgttcgcctccagcgggagctccgccatgtgcaggaccgtgcgggccacgtcggcggcgtccatcaccggctcggcggccagctgcccgttggcctggaggatgccggtctgcatccgctcggtcatctcggtcgccgcgttgccgatgtcgatctggccgcaggcgatccggtagggccgcccgtccagcgagagggacttggtcaggcccgtcatcgcgtgcttggtcgcggtgtaggcgatggagttcgggcgcggcacgtgcgccgagatggagccgttgttgatgatgcggccgccctgcgggtcctgccgcttcatctgccggaaggcggcctgcgcgcacaggaaggagcccgtgaggttgacgtcgacgaccgagcgccaggcctcgtaggtgaggtcctccagcgggaccccgcccggaccgaaggtgcccgcgttgttgaagagcaggtcgagacgcccgtaccgggcccggaccgactcgaacagcgcagtcacgtcgtcggggtcactcacgtccgcccgtacgcacagcacgtcggcgtccggtccggcggcttcggcggtctcctccagcggctcggcacgacggccggccgcggccacggcccagcccgccgcgacgagggtcagcgccacggagcggccgatcccggaaccggcgccggtcaccacggcgatcttcttcgtactttcgtccatggggccgcagggtacgtcacacgacgccgcgtgccccggacgttccgattgctgagagcatgggtcggtcaggggtgcgtagatcagatgagaagactggagttccgcatgtcggagagaggccccgcgacggccgcctcgcacgactcgtcgcccgaatcgccctccgcccccaccgccgaagtgcccctgacggccgcacgccgcacgggtctgctggtcaccttcatactcggcgggctcaccgccctccccccgctgtccatggacatgtacctgccggccctgccgcaggtcaccgatgtcctgaacagccctgccgcgaccatccagctcaccctcaccgcctgcctcgccggcatggccctgggccagctcgtcatcggcccgatgagcgacaagtggggccgccgtcggcccctgctcatcggcatggccgtctacgtcctggccaccgcgatctgcgcgctcgccccgaccgccgagctgctgatcgccttccggctgatccagggcctggccggcgccgccgcgatcgtcatcgcccgggccgtcgtacgcgacctgtacgacggcgtcgagatggcccggttcttctccaccctgatgctcatatccggggccgccccgatcatcgccccgctcatcggcgggcaggtgctgcgcgtcgccgactggcgcggggtcttcgtcgtgctcaccgtcgtcggcacggtgctcacgctaatggtctggcgcggcctcggcgaaacgctgccgcccgagcggcggcacaccggcggcgtcggctccgccctgcggaccatgcgcgggctgctcggcgaccgggtcttcgccggctacaccctgaccggcggcttcgccttcgccgtgctcttctcctacatatccgcctcgcccttcgtgatccaggagatctacggggcctcgccgcaggccttctccctgctcttcgggctcaactcggtcggcctgatcctcgtcggccagatcaacggcaagctgctggtgggccgggtccgtctggacaaggtcctggccgtcggcctcgggaccatcacggccgcggcggtggccctgctgctgatgtcgaccggggtgttcggggaggtcgggctgactccgatcgccgccgcgctgttcgtcctgatgtcggcgatgggcgtggtcctgccgaacaccaacgcgcaggccctgatgcggaccccgcacgcggccggatcggcctccgcactgctcggcacctcctcgttcctggtcggcgcgatcgcatcgccgctggtgggcatcgcgggcgaggacacggcggtaccgatggcactggtccagctggtgtgcgcgctcctcgccgtgggcgccttcctcgggctgtgccgcccctggcagaccgcgtccgccgagtgaggcgccgtcccgggcccgccggcgcctgaggcgccgcttccggccccgcccgcccgcggcgggcggggccgatccgacggctccgcccggcggcataaacttcgcaggtgaacgcctccgcccccacctccgccgagaccctccgcagcacgctgggcagactgctcgacggaatcccgccgaagcaggccacggccgccgtcgagcggctcatcgccagctaccgggggcagaccccgaccgacgcgcccgtactgcgcgaccgctccgacgtggcggcgtacgcggcgtaccggatgcccgccaccttcgaggccgtccggggcgccctcgacgggctggccgaggcggcgcccgactgggcgccgggctcgcacgtggacgtgggcggcggcaccggctccgcgacctgggcggtggacgccacctgggacggcccgcgggagaccacggtgctggactgggcggaacccgccctggccctcggccgggagctggcggccgcctcgacctccgaggtgctgcgcggggccacgtggcggcgggcggtcatcggctcggcgctgaacatccccgaggcggacctggtgacggtgtcctacgtactgggcgagctgactgcgcaggcgcgcaaggccgtcgtcgccgaggcggcgcgggccggccaggccgtggtgctgatcgagccgggcactccggaggggtacctgcgcatccgcgaggcccgcgaccagctgatcgaggccgggctgcggatcgccgccccctgcccgcacgacgggacctgtccgatcgaggtcggccaggactggtgccacttctcggcgcgggtcagccggtcctccctgcaccggcaggtcaagggcggctcgctgccgtacgaggacgagaagttcagctacgtcgccgcgacccgcttcccggtggagccggccgcctcccggatcacgcggaagccgcagatccggaaggggctcgtcctgctggagctgtgcggccccgaggggaccggcctgacccgggtcaatgtgaccaagcgccacggcgacctctacaaggccgcccgggacgccgactggggccaggcctggcccccggcaccgcagccgtagccgcagccgcagcagcagccacggcagcagccacggccggaaccggtgctacgggcgcagctcctgggtacagcacttcacgctgccgccgcccttgagcagctcgcccagatccatcgggaccggctcgaagccccggtcccgcagcggctccagcagtccggtcgccgcctgcgggagcaggacgtgcaggccgtccgagaccgcgttgaggccgagggcggccgcgtcccggccgtcggcgatcagggcgtccgggaagagccgcctgagcactccctggctgccgggcgagaaggcgtcggggtagtacatgatctcgtcgccgtcgagaacgctgagcgccgtgtccaggtggtagtagcgcgggtccaccaggtcgaggccgatgacggggcggccgaagaactcctgggcctcgtcgtgcgagagcggactggagcggaagccccggccggccaggatgtagcggtcggtgaccgcgaagtccccctcgccctcgttgacgtgggagggctcgtgaaggtcggagtagccgttgctccggaaccagtcgaggtgcctctcggcctcggcggcccgttcggggtaggcgaaccgggccccgaggacgcggccgtcgacgacgagggcgccgttcgccgcgaagaccatgtcgggcagcgcggggtcgggttcgagggtttcgacgatgtggccgagggagcggtaccggtcccgcaggtcctcccactgggccagggcgaggggcaggtccaccggtttcgtgggatccatccacggattgatggagtacgtgaccttgaagtgtgcgggtgggcacatcaggtagcgccggggtgtggcgactctgcgcaaagaaggctcctcacgacttacacgactcgggacgagtgctggagagaatcgtctctccttcacctggacagcacagtgaactgattgggtggtttacgcaaaccctcggaaagacgaaacgtctcgctttgataatttcgggccatgcccaagacccctgacgccacccgccgcaacgaccgctcccggcgcgccatcctcgacgccgcgctcgccctcgtcggggaggtcggctacaacaagctgaccatcgaggccatcgccgcgcgtgcgggcgtcggcaagcagacgatctaccgatggtggccgtcgaaggccgccgtcctcctcgatgcctccctggccctcgccggggacgcggagacggagtccgagtggaccggcttccccgacaccggggacctcgcggccgacctcaagcacgtcctgcggctgacggtcgacgagttcaacgacgagaagtacgaagcccccgcgcgcgccctgacggcggccggggccaccgaccccgagctcggcgcccgcttcaccgagcagctgctggagccccagctcgccctgtacgaggagcggctgcgcgcggcccgcgaggccggccagctcgcgccggacacggacctgcgcctcacggtcgagatgctcgtcggtccgctcacctaccgctggctgatgcgcaccgcgcccctgacgcacgcctacaccgacgcgctcgtggaccgggtgctgggcggggtggccaacgtcaccgcccgctagcgggcagggaatcgaagatcggccgagaacatttggcctgtttctatggttatgtgggggtttccggacgcgcatcttcagccccccggtcgtcgagagcggtcacccggggctcaggatggtgggaccatgggttggtccgccggggatacggtgaggtgaggggatagatggggtctgagtccggccgcgtcaaacgcggcgagcagagcaggatttcccagtggctgcgccggcggcagaaacccaccgccgaggaccccggagccgagcgcgaggcgctcctcctggccgtcgccgccgcgggcctgccgctcgcccccgccgcccatcccgccggttaccgatgttcgtgcgaccggatcggctgtccgacgcccgcacggcaccccgtctccttcgcctggcagacccagtcgaccaccgaccgcgcacaggtcgaacgctgggcgcgcaaccagccccaggccaacttcatcaccgcgaccggcatggtccacgacgtgctcgacgtcccgctggaagccggcaccgacgccctcgaccggctcctgctcgccggcatcaaggtgggccccgtcgccgagtcgggcggcaccggcgaccaggcccggatgctcttcttcaccgccacccgcggcacccccgaggacgaggacgagtggtggccctgcgccctggactgccaccccgagaccatggacgaacacccgggcctgcgctggcactgccggggcagctacgtcctggtcccgccggcggccctgcccggtgaccagtcggtgacctggatccgcggtatggagcacgccctcccggacccgctcaccctcctggagaccctgacggacgcctgcgccacgtacgcgggtaccgcgaacctgaccccagccacggtcgcctggcccctgggccactagcccgggctccgccccgaaccccgcgcctcaaacgccggcgaggctggaatcgcgcgggggtgcgggggggcggagcagccgacagcggcgccgtgcccggctcagtggtggatctgcgtcacgaccacgtcgagggaccacgccttggccgccttggcgggggcctcggcttcgaccgtgtagcccaggtcccgcagggccgtgaccagctcggcgggcgacgccggaacgccccccgcgagcagcaggtcccgtaccagccggcccttcgtcgccttgttgaagtggctcaccaccgaccgcttctccaccccgtccaccatctgggagtgcagcacccggacggtcgcggtccgccccgccacctcgcccttcggcttccacgcggccccgtacgccgccgaccgcaggtccagtaccagcccgtccccggccgcctccggcatgacctccgccatcggcccccgccagtacgcgcccagcgcgcccagcccgggcagtttcacccccatcgagcagcggtacgaggggatcgcgtcggtgatccggaccgcgccccacagccccgagaagacgagcagcgcgtcctcggccgaagtccgcgccgccgcgggcagatcggccaggcccagcgcgtcgtagagcacgcccgtgtagatctcgcccgccggccgcgccccggccgtacgcagctccgcgttcttggcgacctcgccgcgcaggccctcgctcaggcccagcacctcgcgcgccttcagctcgtccgccgcgcacagctcgaccagctcctccagcaccgccgcacgggccggggccagaccgggcagcgacagcgcctccggcttcaggggtgcgccggagccgccggcggcctttccttcggacggcggcagcagcacgagcacggtggttctccttcggtacggcgtcgcggggggtgcggcccccgagccagggtagacgtccgcgccgcccgctcgccgcgccgtccgggccgcccgcccctaggctcgacgcatgccacgccgtcagatgcacatgaccggcgcagacggggctgctctgcgggccgcgctgcgcgaactgcggacgaagctgggggtgcccgaggggttcccggcggcggtcctcgccgaggccgagcaggcggcggcgcacccccgcctcccggacctggacagtacggacatccccttcttcacgatcgacccgccggcctccgtcgacctcgaccaggccatgcacctggccaagcgttccggtggcggctaccgcgtccactacgccatcgccgacgtcgccgccttcgtcgcccccggcggcgcgctcgacgccgaggcccaccggcgcgtgaccaccctctacttccccgacgggaaggtcccgctgcacccggccgtcctctccgagggcgcggccagcctgctgcccgaccaggtccgccccgccctggtgtggcggttcgacctggaccccgacggccgggtcgagaccgtcgacgtccgccgcgcgctgatccgcagccgggccaggctcgactacgacggcgcccagaaggccatcgacaccggcacggcggaggagccgctcgccctcctgaaggacatcggccggctccgcgaggccctggaacaggcgcgcggcggcatctccctcagcgtgcccgagcaggaggtcgtcgagcgcgacggcagctactccctggcctaccgcgcaccgctgcccgccgacggctggaacgcgcagatctccctgatgaccggcatggccgcggccgatctgatgctggccaccggcacgggcatcctgcgtacgctgcccagcgcccccgacggcgcggtcggcaagctccggcggacggcgaaggccctgcggatcgactggccgcaccacgtgccgtacgccgaactcgtacgctccctcgacccgcaccgccccgcccacgccgccttcctccaggagtgcacggccctgctgcgcggcgcgggctacacggtcttcaccggcggcgagagccccgacccggcgatccattccgcggtggcggccccgtacacgcactgcaccgcgccgctgcgccggctcgtcgaccgctacggcggggagctgtgcctggcggcggtggccgggacggaaccgccggcgtgggtcctggcggcccttgccgcgctcccggacgagatggcggagggcagccggcgggcgaacacggtggagcgggagtcggtggacctggtcgaggccgccgtactgaaggaccgcgtcggggagaccttcgaggccacggtcatcgatgtcgaggaccgggagccgcgggcgggcacggtccacctggaggatccggcagtggtcggccgcgtccggtccacgacgccggacctgcccctgggcgaacggatccgggtccggctgacggaggccgacccgggcacctcgaagatcctcttcgcgtcggtcccgtagacaccccctagggaacggcgggccgtcggcgcagggcggtgaccagtgtgcgcgggtcgtcggcgtggaagcggacggtccgggcctcgcccgtggcgccgagcggccgggtgaaggcgagcggccggttcagttccagggtgacggtggtctggctgccgacgacgaggtccagcaccccgtcctcggagagggtgaccagcctgccctcgggatagcgccggtccacccgcgccgaggccaccgcgtccgccggtacgaccaggtcgaacagggccccgtagcggatccgcagggacccgtcggggcggaccacgtgcggccgggtgacgcatgcggcgtgcagggcgaggacgaggaggattccgtacacgtccagcaccagcaccacccggtgcaccgcgggccaggggatgagcacggccagaccgacggtctcgatcaccgacacgaagagcatcccgtacatcatggccgtctgcggtccggtgtacggggcggcgaggtctccggggcgcaccccgtgcctccggcggacgacccaccggccgagcgctgcggtggcccgcaactcgtgcagcaccaaccgcctgacctgcacggggaccacggcccggaccgccgcgcgacaggcggcccgccggccggcgccgcgggcgcgttcggcggcgtaggggccgtgcagcaccccggcctccagcagcacgccgacgaggagcgcctcggtggcggcgggcacccagccgggcaggcgcaccccggccgccaggcacaccacgagcgccagctccgccgggacgacggcggtgacggcgatccgtgccgcgcgtatgcgggtcatccccgccccctctcgatgaacgcctccatgacgaggcggacgacttcggcctgcgcgggcgcgtactcggcgagcagcgcctccttgaacccggccaccaccgtcccgtcggcggggaccgcggcgaacacctcgtcgggaacggccgccaccagctccgccgccaggggcgggatccgcgggtcgtcgacgggcgcgtcggcgagctcgtcgaggcgtacgtacagcgcgagcacggcgggatcggcggcgagcgggccgagcgcggcgtagacctcctggccgccggcgcccgtggcgtcgaggaggatcaggtgctcgcggtccttggcggcggccggggagtcggtcaggggtgccttcgccagcagcgcggcaagtgcgggcgagagcggctcggcctcgcccggcccggcggcgagcagcaccgcgaggcggcgccggcgttcccggatctcggcctcctgccgggccaggtcggcgtccagttccgtgaggacgtcggcgagttcgcgcccggcgtcgtcggcgaggacgtcccgcacctcgtcgaggctgagcccgagctcggtgaggcggcgtacgcgggccagcaggacggcgtcccggaggctgtaggcccggtagccgttggggcgccgctccggttccgggagcagcccgacatggtggtagtgccggatcgcccgggtggtgagcccgacgaccgcggcgatctctccgatccgcatgcccccagtagaaaccctgccgttgcgtcaaggtcaagcgaggtcggacgcggtcgtcgccgcgggtaacatggtcgccacggcagacgagtcggccgggcggccgcgtcggggtctcaggatcccgccgaggaacgtccgggctccacagggcagggtggtggctaacggccacccggggtgacccgcgggacagtgccacagaaaacagaccgccaggggcctcggcccccggtaagggtgaaacggtggtgtaagagaccaccagcgcctgaggtgactcaggcggctaggtaaaccccacccggagcaaggtcaagaggatccgtccccggacgggtctgcgcgaacgcttgagggctgcccgcccgagttcgcgggtagaccgcacgaggccggtggcaacaccggtcctagatggatggccgtctccccggcgaccgcgaggtcaccgggcgacagaacccggcgtacaggccggctcgtctgccgcttccactcccgttcgggggcaagcggttctctctccggctcggctcccgccgggcgctgcccggacccgcgcctcaaacgccggcggggctgggtggtgtggagcggcaggacttcgacagcgcgacctggccccacggaccgccgggctcgtttcccggatcccccgacgcgtggggagcggggacgggcaggggtgtccccgcaggacgagcgcgcacccccgatccacagccgagacatgcctgaccgcgcgagccgaggagacacccctgcccgtccccgcggacccgcccgcaccgcgacggatcccgcccggccccccgccagggctaccgcaggtgcgaggtgtcgttcaggaggcggaccgaggcgttgccgtcggcgtagtaggccaccgccgacagggaggccgccgacagctccatgcggaacagggcctccggcggggctcccagggccaggcggaccaggatcttgaccggggtcacgtgggtgaccagcaggaccgtgcgccccgcgtgggcggacagcaggcggtcccgggtagccgagatccggcgggtggcggacatgaagctctcgccgccgcccgtcggggccgccttcggggagtccagccacgcctggaggtcgtccgggaagcgctgctgcacctcggcgaaggtcaggccctcccacgccccgaagtccacctcgcgcaggccttcttcgaccgtcacggtgaggccgaggcggtccgcgaccgcctgggcggtctcccggcagcggcgcagcggggagctgatcaccgtctggacggtgccgcgggcggccagcgcctcggccacggcggcggcctgccgcaggcccgccggggacagttcggggtcgctgccgccgctgccggagaagcgcttctgcggggtgagggcggtctcgccgtgccgcagcagcacgaaggtcgcgggggcgcccatgtccgggccccagccgtggctcccggcggcgaccgccggggcatcgccgtcgaggcacggctcgatcgcgtccgccagggcctcggcgtcggcgaacagcgtgtcggcgtactccgaggacgccgcgcccggggttccggaagcggcggccagggctgcacggaccgccgcggcgcccttcgccgcgtcccccggcgggcccgccggcgccggcggggtggcgagggagcgcgccgcgccgtggtcgagggcggcgctggaggacgagggctcccactgcctgccgcgcttgcccgcgtccatcgcctcgttcgcgagccggtccgcgtgcttgttcctctcccgcgggatccactcgtacgtcacctgggcgcgcggcaggatccgcgcggcctcggccgcgagcggcttcatgtcggggtgcttgatcttccagcggcccgacatctgctcgacgacgagcttcgagtccatccggaccaggacctgcgcgtcggccgcgagctcacgggccgccgcgagcccggcgatcaggcccttgtactcggccacgttgttcgtcgcgacgccgatgtactcggcgcgctcggccagcgtctcgcccgtgaccgggtcgagcaccaccgcgccgtagccggccggccccgggttgccccgggaccctccgtccgcctccacgaccaaccggacagggctcggcatcagatgcccgagtccgccgtacggaccaggatgcggccgcagttctcgtgacgtacgacctggtcgcgggccgcggccttgatctcgttgacctcggccatgtcgagctccagccggcagccctcgcagcggcgctggtagaggcgcgcggcgccgaccccgccctgcttgacacggatcttctcgtacagcgccatcaggtcggccggcatggacgcgacgatgacctcgcggtccttggtgaccttcgcgacctcggtgtcgatctcggaggtcgccgcgtcacggcgggcggtggcgtccgcggccttggcctccagggcggagacgcgctcggtgagcccggtgacgcgctcctgcgcaccctccagacgctccatgacctccaggaccacgtcctccaggtcaccctggcgcttggcgagggagacgacctcgctctgcaggttcgccaggtcccgggccgagatgcccacgccggagtcgagccgctgctggtcgcggacggcgcgctggcgcacctggtccacgtcctgctccgccttggtctgctcgcgcgcggtgtcgctcgcctgggtctgggcggcgacgagcaggtcgcgctgctgcgccaggtccttggtgagcgagtcgagctcggcgtgctcgggcagcgacttgcgcttgtgggcgagctgagacagccggacgtccagcgcctggacgtcgagaagtcggatctggtcggcgggctcggcgttcagttgggggctccagagatagaagggggtgtgacggacggcgcgtgggccgtccacgggtcggtgaccgtgcgcgagacgtgggtacgaagaccccagccgtggcgctcggagatcgcgtcgagctgcgcggcggcctgctcgcaccagggccactcggtggcccagtgggcggcgtcgacgagggcgagcgggcggctcttctcgcgtgcctcggacgccgggtggtggcgcaggtcggcggtcaggaagacgtccacgccggcggcgcggacctcctcgaagaggctgtcgccggagccgccgctgacggcgatgcggcggaccggcatgtccgggtcgccggcgacgcggatgccctgcgcggtcggcggcagccaggccgcggcgcgggcggcgaactcgcgcagggtctcggggtggtccagttcgcagatccggccgaggccccggcggccttccgggtcgctcgggtcgggcaccagcgggccggtgatccgcaggtcgagggcgccggcgagggcgtcggagactcccgggtcggccgtgtcggcgttggtgtgggcgacgtgcagcgcgatgtcgttcttgatcagcgtgtgcacgacgcggcccttgaaggtgccggcctcgacggtggtggtgccccgcaggtagagggggtggtgcgtgatgatcaggtcggcgcccagcttcaccgcctcgtcggcgatctcctggacggggtccacggcgaagaggacccgggtgacctcggcgtccgggtcgccgcagacggttccgacggcgtcccactgctcggcccgcgaggggggccagagagcgtccagcgcggcgatgacttcagagagacggggcacaggccaaggctaccgtccgagccacctgtcccgttcagcccgtacctcgtggacgaacccctgcaaacgcgtatgaaacagccgtgctgcctccgggtcgtcgcgcgcggccgcgggcccggtgccggacgggcccggcgccggggccggggcgggcgggcgtcgccgcaggccgcccagcacacgcggctctcccgccacgggcgaatcgccgcgtggacacccgtatgtgtgaagccgagttggtcgtgttgttcgccgtgacaccagaaaactagcttcccccccggaggtgcccacggatgactgtctgtgccatcgaaatgacgaccacggccgcgttcaccatcgccgcggacgggtcgtacgccgcccggctggccggggagggcgacgctctctacgtggagcgctggaccctcgccgggcccgaggcgtacgcggtaccgctgccgctcgcgcagcccgaggaggcggacagcgaggtgctgccgctggccgacgggcgggtgctgatccaccggcgggtcgcggatcggcacgccttcgcgctgctgtacccgacgggggccgaggccgggccgagcaccggggagctccagctgggcggggtcgaggtccgggagggcgtaccgctgcggctgctcccgccgtccccggacggccacggcgccttcgccctggccgcggaggacaccgtgaccacgatctggcaggtcaccggggcccccttcgggccgcagcccgtcgcccggatcccggggcggtgctcgggcggtgtctggctggaccgggcgggccggctgctggccctggaccgcgagctggacggcaccgtgaaggccgtcgccgtggacctggcgtgcggcgcggtctccccgctgctgcagatcaccgaggacagcgacgaccggctgctgctggccgacccggacagcggcctgctgctgatccgctccgacgccccgggcacctcgcgcctgggctggggggtgtcgggcagctcgctgccggtccgcttcccggagtgcctggcccggctgggggacgcccggccgttcgcggtccagcccggtcaggccctgatgccggagacctgcggggtggcgctgcggctgcccgagggcggcatcggcctgtggcgccccgccgaccggcgcgtcttccgggtcgccgccccggcgggctggctcggcgggaccggcctgtggagcccgcggggccgcctgcacctcccgtacgcgacgcccgaggtgccctgcgggatcgtcggcctgaacctgccggcctcccctcccccgccggtggtcctggacccgcccacgacgaccgccccccgcccggtccccctccagcaggcgccgctggcgggacgacaggagcaggggccggccgccccctgaggcacgtccggagggctcaggcgtgcttgaggcccagtacctccgtcgcggcgaaggtctcgttcgccgggcgggactcgtagtgcgcggtcagcagctcgtcgagctcctcgtaggagaaggactccttcgccgtgtcgaaccgggcggccaccttcgggcgctccatgacgaccacgatgccgccgtgcacgacgaacagctggccgttggccctggccgaggcgggcgaggccaggtagccgacgagcggtgagacgtgctcgggggcgagggcgtccagcttgccctcctccgggagctggaagccggcgaagacgtcctcggtcattcgggtgcgggcccgcgggcagatggcgttggccgtcaccccgtacttggcgagcgccagggcggtcgaggtggtcaggcccacgatgccgcccttggccgccgcgtagttcggctggccggccgagccgccgaggaaggcctcggaggaggtgttgacgatccggccgtagaccgggccgcccgccgccttcgagcgctcgcgccagtgcacggacgcgaagtgggtggtgttgaagtggcccttgaggtggacccggatcaccgagtcccactcctcctccgacatcgagaagaccatccggtcgcgcaggatgcccgcgttgttgaccaggatgtccagcttcccgaaacgggacaccgccagctcgaccagctcccgcgcctgggcgaagtcggccacgtcgcccaggtgcgcgaccgcccggccgcccgcggcgcggatctccgcggcgacctcttccgccggggcggccgaggcctccccggagccgtcccggcccggctggccgaagtcgttgacgaccacgctcgcgccgagccgcgcgagctcgatcgcctcggcccggccgagcccgcggcccgcgcccgtgacgatggcggagagcccctcaagtggcagtgacatccgtagcgttcctctcgcagtggtcgggcggggcagcgggtcggcgggtcagagttcgatgcaggtgcgcagggcgacgcccgtacgcatctggtcgagcgcgtcgttgatctcggcgagctgcacccggtgcgtgatcaggctcgccaggtccacccggccggcccgccacagcgcgatggtgcgctcgtaggagcggagcacgtccccgccgccgtacatcgacggcaggatcttcttctcgtcgaagaagagcgagaacatgtcgatctggtagttgtcgtccatcgcgccggcgccgacgatcaccacgctgccgccgcggcgggtcatcttgtaggcggtctgcgcggtggcggacttgccgaccacctcgaagacgtagtcgaagccctcgccgccggtgatccggttcttggcgtcgtcgaacgcctccggccccacggcctcggtcgccccgaaccgcagggccgcctcgcgccgcgactgcaccgggtcgacggcgatgatctgggccgcgccctggaccttggcgccttggatgacggatatgccgacgccgccgcagccgatgacggcgacggaggacccggcttccaccttggcggtgttgatggcggcgccgaggccggtggtgacgccgcagccgatgagcgcggcgatgtcgaagggcacgtcgtcggggatcggaacggcgcacgcggcgtcgaccacgagctcctcggcgaaggtgccggtcgcggcgaagccgaagatgtcaccgcccgcgcggcggaagttgggggtgcccgcgttgaccaggctcgccaggcacaggtggccctggccgcgcttgcaggacggacagtggccgcagggcggcagccagcagacgaggacccggtcgccctgcttgagggtggtgaccccgtcaccgacgtcggagatcaccccggagccctcgtggcccgggatgaagggggcgggctgcggcaggacgccgctcatcgcggagaggtccgagtggcacaggccggtggccttgatccggatcttcaccttgccggggccgaggccgacggcctccatgtcgtcgacgacctccagcttgtcctggccgatctcgctctgcagtgctgcgcgcacggtgcggctccttgggtctcgtactcgtacggtcctgttctcgtacgcgtggtgacgcgtgctcgtggttacgcgtgctcgacgacggtgtcggcgaggaccggcgcgtcgtcccgttcggccgccgtcaccgacaccaggacccggccgggctcctcccacatccggatgcgcagcgtctcgcccgggaagacgatcccggcgaagcgcgtgcggtaggcccggacccgcgagacgtccccgcccagggccgtgtcgacgacggccttgagggtcatcccgtacgagcacaggccgtgcaggatcggctggtcgaagccggccgtcttggcgaactccgggtcggcgtgcagcgggttccagtcgccggagaggcggtagaggagcgcctggtcctcgcggatgtgccgctcctcgacgcggtccggggcgcgttcgggcagttcctccctgacggaggggccgcgctcgccgccgaacccgccctcgccccgtacgaagatctgcgcgtcgctcgtccacaggggcccgtcggcgtcggcgacctcggtgcgcagcacgacgacggcggccttgcccttgtcgtagagggccgcgacccgggcggtggaggtggccctgcccttgacggggatgggccggtgcagctcgatggactggccgccgtgcaggacgttggcgaggttgatctcgatcccgggggcggcgaggccgcccatcatggccatcccggcgccggcgacggtcgcgaagctgggcaggacgtgcagcttggattcgagggtgtagcggagctcgtccgggtcggtggccggccggcccgcgccgaggccgaggtggtagagctggatgtccttgtggtcccagccgatctccccgtggcgggggtcggcggcgagggccttggcggcatcgatcggcatgggggtgctgctccctgtcgttggagaaccggggccggggaagagccgtgcggagctgttggacagctgctggaagacctcggtgcggccgtccgcaccgtcggccgcaccgaggtcgtgtgcggggccggttctagaacgcgttctaggcccggccggtgagggaatgtataacgcacgcccccacacttgggaagactcttgacttgacgtcagatccactgcctgcggggcgtgttgcgtgcccgccgggaggcggggcaataccctgcccgcgtggaagaaatgcctgttgaccaccgtgaggtccgcgccttgcgcgtcctgctggagccgccgaatccggccctggcgctccagctcggcctccagccggacatcgaggtcgtccgggacccgatggcccggcccgcggtcgccctggtggaggagctcgcggccgtgtccgccctgctggccgacgacccggagtgccgggtcctggtcctgacgggctcggcgcaccccggcctcgcggaggccgccctcgccgcgggcgcggtgggactggtgctgcgggacggccgcgtcgaggagctggcggactgcatccggcgcgcgtcgacgggcgagacggtggtggacccggccctggggtgatccggacggatccgcgagaatcccagtcagtcccgatgagtcccggtgaatcctttcgcggtgcccgcgcctcttatgcgtgtgccgacgacgagatcggcactgacctggaggttgtcgtgatcacttttgtcgccgccggcgccgtcgtactgctcctgctctgcacgtgcaccgttctcgtggcgcgccgacggagccgctcccgtggctgagtcgacctggcccgccgagccgctgatcctcgccgcgcagggcggggacgtcgatgcggtcaccgcgctcgtctccggatcgcacccgaacgtgcggaggttcgcgtactcgctgtgcgcctcccccgaggacgccgaggacgcggcccaggaagcgctgatcatcctctaccggaagatcggcatgctgcgcgcctccggcgccctggcctcgtggatgttccgcatcgtccgcaacgagtgcctgcgcagggcccgtctggtcccgcgcgagcgttccgctccgctgccggacaccggcgaagcggtgatgtcggccgaggacgaggtactggaacgcctggaggccgcccgggtggcgcgcgcgatcgccgccctccccgccgaccagcggcgggtgctgatcatgcgggacatccagggctacagcggccgcatggccgcggacgcgctcgggctcagccccgccgcgatgaaatcacggctgcaccgggcccgcgcggcccttcggcacgccctttacccgattccaggaggcgacgatgccgatcactgacggccccgacttcgcgagctccaccctgccccggcacctggtccgcggcgcgatcggcctcggcgccctggccggctccgtcgctctcctcccgctctacggcccgatcaccctggccctcgccccggtcggtctgctggcactgcgcggctgcccgatgtgctgggcgatcggactggcccagacgctctcccggggccgcctgcaacgggagtgcacggacgaccgctgcgaactgaaggtggcaccgcgctgatcccggccaccgattgacggattccacagcagcgcatgcgcacccgctgggagcaggatgagacctcctcggcccagcttcgtggaggcaaaaccatgcgtgtagccgccctgtccgccaccgccgcgctcgtgctcgcgaccctcgccggaagcgtcgctccggccgctgccgacaccccggccggcccggtcctccaggtccccctggaggccggcaacggcctccaccacagcaccggaagcgtggtctacgagcgcgtcgacggcgaggtgaacgcggtcaggatcatctcggtgtacgtcaccggcggcgatcgcgactgcgcctggctggactggaacgacccgcacaaccccaacggctggagcagcctcaccagcgagccctcctgcggcggcaccggcctggaggagcaccccgaccggatcgtcaaggcgccggtcggccacccgctcaaggtgcgcctggccgcctaccaccgcgactcggccgaagtgaagcacaaggacatcgagaagctctgaccgggcgcggggcgggccggggccgctacgagccgtcgcccgcccgctcctgcccgaaggcggcgaggagctcgctctcgcccggggcggtgaacagccgcttgggcagcaccacgagacacgtccggcggcgcgagcggcccacgaacacgtgcagccggggcgtctcgtggtagaagcgcacctcgtcccacacgatccgctgcgactccccgccgcggaacacctcgacgccggtgccgtccaccacgacccgcttctcctcggcggccctgccgctgcggaagccctgtgccaccgcccacctcggcaggaccagcagcgcgacgaggccgtacgccaccgcgatcgcgagggggacggggtgcacggtgagaccgcctgaggacagcgtcacgcccgccgaagcgagcaggaccgtaccgaggacggccaccacccgtccgcgccggaagaaccccgccgccctggcggcctcgtcgtactcgtccctggtcacgctgccggtggcactgaaggacgtctcacgtatctcgctcacgggagcggagcctagcgaacaggaccgcggcctccccgccctgctggacggggaggccgcgcaggcggccccgacggaatcagcgccgcaggagggtgaccaccgccgcgccgcccaggccgatgttgtgggccaggcccacccgggcaccctcgacctgccgggcgcccgcctctccccgcagttgccacaccagttccgccgcctgtgccaggccggtcgcccccagcgggtgtcccttcgagatcaggccgccggaggggttcaccacccaccgcccgccgtaggtggtcgcgcccgactccaccagcttcccggccgcgccgtccgcgcacatgcccagcgcctcgtaggtcagcagctcgttgatcgagaagcagtcgtgcagctccaccacgtccacgtcctcgatgccgagtcccgaggcctcgtacgcctgccgggccgcggccgccgtcatcggcttgccgaccacgtcgatgcaggagcccgaggcgaaggaggcctcggtgtccgtcgtcatcgcctggccgacgatctccaccgccttgtggtgcagcccgtgccgcaccatgaaccgctcggacaccacgagcgccgccgccgcgccgtccgaggtcggcgagcactggagcttcgtcagcggcgcgtggatctccttcgccgccaggacctcctcgaccgagtacacgtcctggaactgcgcgttcgggttgttcgccgagtgccggtggttcttcgcgccgaccgtcgcgagctgcgcggccgtggtcccgtaccgctccatgtgttcccgcgccgcgttgccgaagatctgcgccgtgggcggggacatctcgaagccgtggcccgcggccatgatcccgtagtgccgggccaccggcgacgtcttgaagtccccgccgtccgagccgccgcccagcgcgccgcgcttcatcttctcgaagccgagcgccagcacgcagtcgttcaggccgccctccacgaactgccgcgccatcatcagcgccgtcgagcccgtcgcgcagttgttgttgacgttgtagaccggcaccccggagagccccagttcgtacgccgcccgctggccggcggtggaggcctggaagcagtagcccaccgggacctgctcgaccagcccgtagtccacgcccgcgtcggcgagcgccgccgatccggcctccttcgccatgtcccagtactgccagtcccgcgactccggcttctcgaacttcgtcatgccgacgcccacgatgtacgacttcatgcccgacaactcctaaggggtgtcctgtcgatcagagtggatcagggagcggtggccggtgccatggggtctccccaggcccgccagggccgaggggaaggatcgcaaggccgaccgaggacaacgccgcgaggcgcggcaccggccaccgcgagcccgccctgaccggcaagacaccccctagtccctgggtaggccgaggatccgctcggcaacgacgttgagctggacctgtgtggtgcccccggcgatggtcaggcagcgggacatgagcatcccgtgcaccgcccgctcccccgccccctcccgcaccgcgcccgccggccccagcagttcgagcgcgagctcggcggtccgctgctggtgcggggtctggacgagtttgcgtacggaggcgcccgcgcccggctccagccccgacacctgcgacagggtggtgcgcagcccgatgcaggccagggcgtgggcctcggcggcgagggcgccgatccgcgcccggtacgttccgtcgaggtcggcggcgcgcgcgaggagcgcctccaggccggtgtcgaaggtcatctggtcggccatgtggacgcgctcgttgccgagggtgttgcgggccacctgccagccgccgtccgccgcgccgaccagcgcgtccgccgggagctccacgtcgtcgaagtacacctcgttgaagagggcctcgccggtgatctccttcagcggccggatgtcgatgccgggggtgttcttcatgtcgacgacgaagtagccgagccccttgtgcttgggcgcggccgggtcggtacgggccagcaggatcccgaaatcggcgctgtgcgcggaactcgtccacaccttctggccgttgaccctccaggagccgtcctcccgccgctgcgccctggtccgcagcgaggccaggtcggagccggcgcccggctccgagaagagctggcaccaggtgaggtcgccgcgcagggtcggcaggaggtacgcctcccgctgggccggtgtcccgtacgcgagcagcgagggcaccacccaggtggcgatcccgaggtcagcaaccttcaccccggccgcgcccagctcctgctggacgacgagctgctcgacggggcccgcgccgagcccgtacgggggcggcaggtggggagccgcgtagccggtgggggccaggatccggcgggcggtggccgggtcgagtccgcgcgcgtccgcgatggcggtacgggccttcgcgcggtacgtctcggcctccgcgggcagttccaggtgcagtgcgcgccgcgcaccgccggccgcgcaccgcacggcccgtacgcggtgtccgtcaccgggtcccagcagctggcgggcgaccagcgcccgccgcaggtagatgtgggcgtcgtgctcccaggtgaagccgatcccgccgaggagctggatgcagtccttggcgcacgagtaggcggcgtccagggcggttccggcggcgagggcggccaccagcgagcgcacgtcggcgggctcgtccatggcctgcgcggcgtcccaggcgagcgcccgggcctgttcgagccggaccagcatgtcggcgcacaggtgcttgacgccctggaactgcccgatgggccggccgaactgctcgcggaccttcgcgtacgcggtggccgtgtgcagggcccaggccgcggtgccgcaggcgtcggcggcgaagagcgtgcaggccaggtcgcgcaccagggccgcgtccaggtccagcagccggtccggggcggtggcgaccccgcgcgcccgcacctgggcggtggggcgggtggggtcggcgctctcgtgcgtacggatgtcgagcgcggcggcgtcgacggcgaaccagcgggtgccgtgcgcggcctcggcggcgagcagcacgaggtcggcctcccccgctccgaggacgggcggggcgagtccgtcgagcaggtacccgccgccctcgacggcgacggcggtcagggtccccggcccgagcgcgacggccccgacccggccggcgagcggctcggcgccggcccgctccagcagtacggatgccagcgcgctcggcaggtacgccccgggcagcgcggcccgggcggtctcctcgacgacgacggccaggtcgagcagggtgccgccgtccaggtgcgggtcgagcagcccctgcgcggtcagcgcgtcccagtaggcgggccgcgccccggtctgcggcggggtgtcgagcagcttgcggacctcctcgggaggtacggcccgcgcgacccagccgcgcaccgcctcggccaactcccgctgctcctgcgtgattccgatgcccatgcgcggcagactagaacacgttccagtctgacggaaggtcagatgaagggtgagtcaggggcgggaaccggcgccggaagggccggcgtccaccggcagacaagatcgattgcaccgcgaaggagtccggaatgaccgccacggccacccgatacctctacctcgtccggcacggcgaggcatcacccgacgagagcgcgctcaccgaggccggccgccgccaggccgaactactcggccgacgcctccaggacgtccccctcgcggccgtccaccacggcccgctgccccgggcccggcagacggcgcgcctgatcggcgaccagctgacgggcgtccccgtacacctctcggaagccgccggcgactacgtcccctacgtgccggaacgaagcgaactccctccggaatcggccgacttctacctccgcttcctcgacggcgcctccgccgaggaacgggaggacggacccgggctggcccgtcgggcgatggacctgttcaccgggccggtggagggcgaggaggaccggcacgagctggtggtcacgcacaacttcctggtcgcctggctcgtccgcgacgccatgcatgcgccgaaatggcgctggctcggactcaaccacggcaatgccgccctgaccgtcatccggtacgcacccgaccggcccgcctccgtcctcgtctccaacgacatgcgccaccttccggccgaactgcgctggaccggattcccgcccgagttgcacatctgaacgagacgtcgggcggtgagcggcccccgggcctccgcacgggacggaaggcctcgaatacggcccaagtgcaccgcagaggggagatctaccggctcacttcacctcaactcgggcttatataagggctattgagtacagatgggccgttcactatagtcggcacggacacggccggcctcggtccgagcgtgccgcatcagggattcgactccccttcgtggcgcctgatgtggcgccggcggaagaccactacgtagggggatgaaccatgcgcatgaagcggaccctggcactcctggttgcctcagccgccgtgacgctcggaatggccaccccggccagtgcatacgcatgcaacaccgggtttttctgtctctactacaactcgaaccagggcggcgcccgatggttcacggacggcgacgtacccaatctcgccggggaaatattcaccacgtgggccactggtgagggcgagccggtgaagaacaacgccgcgtcgacccagaacgcctcgaactactgctaccgggtctactacaactcgaactacgccggcccgtacgacaccgtcccggcgcactcgtcccggaacctcgtgaacacgtacaacaacaacgcttccctccgggacatgatctgctgagcaccgcgcccggaccgggaagggtgttccgcggccgcggaccgcggccgcggaacaccctttcttgccacccgtagaggaacccggaatccagtgaacgtgaccaccccttcctcccgagcgcgtgccggcatggcgctgttcctgctcccgctcctgtccgcgtgctcggccggtggcaccggtaccgccgaagccccgcgcccgacggcggcgcagcggctcgacgacagcaagaccctcaagctgcctctggacgattacctgctgaccacgatcgacgcggccgcactcgcgcgcgggcgcgattccctcatgcagcggtgcctcgccggactgggcgccccgtacaccccgaaagcacggggaaacgccgatatcgaaacgaacgagcggcgctacgggctggccgacgcggagctcgcgaaggaacacggctatcacctgcccgacacggacaaaccggccgaagactatccggcgtcggtcatgccgctcgtcacgggtgaaacaaccacgtacaacggcctgcccgtaccggaaggcgggtgcgcgggagaggcgcagcgggagctccacgaagtcgagctgcagacggctctcgcccttccccagaaactcaacatggaaagctacctgaagtcccagaaggctcccgcggtggtcaaagccagcgaagcgtggtcgacctgcatgaaggaatccggccacacctatcccgaccccctcgccgcgataaacgacaaggaattcagcgccccggctcccggagcccacgagaaggaagtggcgctcgccgacgtgctgtgcaagcagaaggtgaacctgatcggtgtctggtccggcgccgaaagcgaataccagacgttcttgatcgagtcgaattcgagcgtcctggcggagccgctgcgcgccaaacagaagaccatggccgcggcgcaggcggcgaccggacgctaagaggtcgttttatccctctgtttcatcccggaattgggtgttctgtggtcttcttcgggtcgcgccaggagacggtgttctcgccggtgaggcggcgggccatgaggtcggtcatcgcgatgtggatgacggcttcggagcgggtgggcagggtttcgtagtcgcgggccaggcggcggtggagcatgagccagccgtaggtccgctcgactgcccaccgcttgggtatgggggtgaaacccttggtcccgggcttgcgtgcggtgatctccatgtcgatgcccagagcggcggcatgctcgaccaggtgctgacggtatccgccgtcgacccacactttgcggattgacgggtggtctgcggcggtctggtcgatgaggcgggtgccggccgcggagtcctgcacgctggccgcggtgaccagcacggcgaggaggaggccgagggtgtcggtgacgatgctgcgtttgcggcccgcgatcttcttgcccgcgtcgatgccctggctggtggcgggaacgctggtggatgtcttgacgctctgcgcgtcgatcacacatgcagttggctctgcattccgcccttccttctcccgtaaaagctgcctgagcaggccattgagctgggcaaatacgccctcgtcagcccatctggcgaagtagccgtagacgctctggtgcggtgggaagtcgtgcgggaggtaggcccactggcagccggtgcggtccacgtagaggatcgcgttcatgatctcgcgcaggtcatgcctcggaggccggccaaagtccagagcccggccacggcgctcgaagcgccaggccgcaaggaccggctcgatcaactcccagcgtgcgtcggacagatcactcggatacggacgtcgtgttgtcatgagtccggcgtaccgccgcggaccgaatgcgcccaggcacacggccgcgacgctggaagcacacgggccgccaatcgacggacatcctgggatgagacaggcgcaagaaccagcccgccccacaagccaccccacacaccccacagaaaccgactccgtcaatggtcactaccgcaccgtggtcgaccacttcaagaatcgcatcaaatctccagattctgggataaaaagacctctaagaggtcatctcataacgtcgccccgggacagggcgccctggcgtggacgggcatcttcggcggcctgttcgcctcgacgctgatctgcgccccggtgatcgtcctggccgtctgcctcagcagcacggaccagcggtccctcgcctggatcctgctccccctgggcggggcttggggcaagctggccacctgggcgggcctgcgccgcgccccagggtggcccgcagggatcccggagatcctcctcgccgtcagcaagggctgaactccgcgctctcgccccagatctcggccgggtgacgacgacgttccccagcacggcccggagtcgtgctggggaacgctgcgaggttcgatcaatctcctcagaagccggcccagaggccggtgctgccgagcatgtcggtgccgccgccgaccgcaccaccgccggtgcccacgtacagcttcatgttgttgttggcgtcgatccccgcgatgtcctgcttgccgtcaccgttgaaatcggcggccagcagggaccggaagcccttccagaggccggtgctgccgagcatgtcgctgccgccgcccacgtgacccgcaccgtcacccgtgtacagcttcaggttgtagttcgcatcgataccggcgatgtcctgcttgccgtcaccgttgaagtctgccgatgtgatcgccttgaagttcttccacagacccgtgctgcccagcatgtcgctgccgccgccgaccgcacctgtaccgtcaccgacgtacagcttcaggttgtagttcgcgtcgatgcccacgatgtcctgcttgccgtcaccgttgaagtccccggccgtgatcaccgtgaagttcttccagaggccggtgctgccgagcatgtcgctgccgccgcctacgtgacccgcaccgtcacccgtgtacagcttcaggttgtagttcgcatcgataccggcgatgtcctgcttgccgtcaccgttgaaatcggcggccgtgatcgccttgaagccccgccacagacccgtgctgcccagcatgtcgctaccgccaccgaccgcgcccgcaccatcacccgtgtacagcttcaggttgctgttggcgtcgatgcccgcgatgtcctgcttgccgtcaccgttgaagtcaccacccaccgtccgcgccatgaccggcgccggaacgggggcagggcagttggcgagcggcgccgggaaggctccggcctggtccgtggagaagggcaggttgtagaaggccagcaagccgattccgttgctgttcgtgatccaggggccggctccgtcgtgtccgacgtaactgacgcctgtggcgccggtagcgggcccggtcagacgcaggtggatgtacccggccctgacggccatcgagaccacggacaccgggctgccgttgatgacgaagttggtggcggggccgcatccggccacgagcgcgtcggcaccgttgcgcagggcgatggtgatctcggtgtggtcggccttggagaaccatgccttttgggcgtcgggagcggtactcgccgcggcgctgccgccgtagtagtcccgggccatggagaggaagtcgcggtcggcgagatcgcggtagccgccgacgtagtagtagtggcaattgtcgggaccctgcccgctgatgccggtggtcgacaggaccgtgacgcccgggagggctgcgtactgccgctgcgcctcgcgctcctcgtacgagttctggggcgcgccggtggcatcgagacaaccgttgcggatctggtgggcgtacacgtgctccacgcccgtgaagtcggtcttccagtcggccaggagggacttgaatccggaggtctggctcgcgacgttgttgttgtcggactctccctggtaccagaagatgccacggacctggctctgcacccccgcccgccgggcacggcccagcaggcgtccgtaattggtgccggcgtccgcggggttcgcgtcgttgcgctggaagaaggagaccgggcgaccctcgtgaccgccctgcaggatggcgatggggatgccgtacgtgttcacttcctggcggcccaggcggagcccgtactggccgatcgcccccgagacctggtaggagtcgccctccgcgacctgccaggtgtcgtcctgcgtggcggacgcggggtcggacgtggacgatccgaaggtacgcacccagggcgaccggtccgcgctgctggagttggaggtgtcagacgggtttccgggattggacgggaagtgctggcgggcggcggcattggactggccgctcacgatgaacacatcgcccgccacgatgtcgttccacgtgctctgcagcgtggcggtggaaccggagacggagtagaggctgaaggaatagctgttcagactcgccgggatccggggcgcgaaggtgaacgtcgatccggcaccgctcaccgggacgctgctgctcgacagcgacgccccgtcccgcgcgatgtccaggcgcatcgaggtggcgccggcctgcgtgacgctgccggcaatggtgacggcggcgttgttcgtggcaaggtcgcgggggaagagctggtggtcgcggggggcctcggtgagctggactccgctgcccgccacatcggtctgcagggccgccgaacgtacagccggctgcgctgccgccgctgtgacgaagccgtcggaggcgagcgtggcggtgaccgcgagagacagcgccagcgcgccttgggccaccagtgccctacgactggagatcttctgcatgacagataccttgcttaggggtggggaaggggcgagcgaaggacggacggggccgggttctagaagccggcccagaggccgttgctgccgagcatgtcggtaccgccgctgacccggcccccgtggtcacccagatacagcttcatgttgttgttggcgtcgatgcccgcgatgtccgcgtggccgtcaccgtcgaagtccgctgccatcagggaccggaagcccttccacaggcctgtgctgcccagcatgtcctggccgccggcgagctggcccttggagtcaccctcgtagtgcttcaggttggagttcgcgtcgataccggcgatgtccaccgtgttgtcgaaggtgaagtcggcggccgcgatcgccttgaagcccttccacagaccgttgctgcccaacatgttggtaccgccgccgacgttgcccgcaccgtcacccgtgtacagcttcaggttgtcgttcgcatcgatacccgcgatgtcctgcttcccgtcaccattgaagtcaccggccgcgatggtcttgaagcccttccacagaccgttgctgcccaacatgttggtaccgccactgacatgacccgcaccgtcacccgtgtacagcttcaggttgtagttcgcatcgatacccgcgatgtcctgcttcccgtcaccattgaagtcaccggccgtggtccgcgccatgaccggagcgggagccgggtcggccgggtagggatcggcgtggtcgctgcccaggccggccgccggtccgcagctgggccaagccccctggccctgggccgcgaggaccttctcgcctatgaggatctgctgctgcttggtggcctggtcggcgcgggcggcgtaggttgcgcctccgaatcccgtccaggtcgacggggagaactggagacctccgtagtagccgttcccggtgttgatgctccagttcccgccgctctcgcacgcggcgaccttgtcccacgtgctcacggaggcggcgccggcggtggcgacgttcaggcagagggcggagccggagatcaggacgacgagggcggccgacagggtgcgcttgctggacatcaacttctcgcttctgagaggaacttactcgacggggggggagggcatggcccggccgaggtccggacctcgatgaggtccggaccccactgcggagacgctgggaggggctggggtttagaagccggaccagaggccgttgctgccgagcatgttgctgccgccgctgaccgtgcccgcgccgttgccggcgtagagcttcatgttgttgttggcgtcgatgcccgcgatgtcctgcttgccatcggagttgaagtcaccggccaggagggaacggaagcccttccacagaccgttgctgcccaacatgttggtaccgccgccgacgttgcccgcaccgtcacccgtgtacagcttcaggttgtcgttcgcatcgataccggcgatgtcctgcttcccgtcaccattgaagtcaccggccgcgatggtcttgaagcccttccacagaccgttgctgcccaacatgttggtaccgccgccgacgttgcccgcaccgtcacccgtgtacagcttcaggttgtcgttcgcgtcaatgcccgcgatgtcctgcttgccgtcaccattgaagtcaccggccgcgatggtcttgaagcccttccacagaccgttgctgcccaacatgttggtaccgccgccgacgttgcccgcaccgtcacccgtgtacagcttcaggttgtcgttcgcgtcaatgcccgcgatgtcctgcttgccgtcaccattgaagtcaccggccgcgatggtcttgaagcccttccacagaccgttgctgcccaacatgttggtaccgccgccgacgttgcccgcaccgtcacccgtgtacagcttcaggttgtcgttcgcatcgataccggcgatgtcctgcttcccgtcaccgttgaagtcaccacccaccgtccgcgccatatgcgtcaccggagccgggtcgtcgacgatgttgtcgtagcgcagcgcgtcgtagtagctggtcggccagccctccagggacgagctgttgatgttcgccgcagtcgggccgtgcgtcgggttgttggtgttgctctcggcgtagtaggtgaaggcgcccgtggcctggttggtccagcccgcgaacaggaaggtgtgtgcggcggtgtagtccatcgcgtcacccgccttgagctgcgagaagctgatcttggtggacacgttgggcagggtctgggtgaccaggctggagttcaggtgccaggccatggacacgtatccggagcagtcctcccggtacgagccgttggagtccgagtggtaggcgccctggttgtacggcacaccctggtcgacccagctctgggcgcgggctatcacctcgccgcgggtgatagtgccacccacggaggaggcggcctgggccggagcggcgagcgttacggcggcaccggcggcggcgagcacggtcagggacgcgagggaagccagagtgctcttggtacgaggcatggtgatgtttccttgaatggttgaggcctggaagtcgaagcgctggacggagctacggggctcagcgagtgagggcgaggcttccggcgagcgtggtcaggaggtcggcgtcggaggcaggggtggcggagttgccctgtccggccgaggtcaggtcgctgtactggaggacggtgagcacattgccggctgcggccagatagacgtggtgggtctgcgcacccggagccgacatgcccggcacggcggtccactggtactgccaggcaccggctgccgggctggtggcggtacgggaggacgtggcgtcgggggtgcggccctgcttggtctgcgcgtcacgcagggcggtctggcagccgtcgagctgggtgttcagcacctggcgggcgcggtcggcatcggtcggggtggcgaaggtgaaggtgtcctggatggcaggggtcttcgcggcgctcgcccagccctgctgctgccatccggtcgcgccttcgacagcggcacattcgttgaggctgctgctgggggcgacatcacggctcttcggcgagccgatcggcttccaccccgccttcgcctggttgggcagttcctggacggtgagcggggcgggcgccttgccggtcgccgccggcctggccgtcttcggccgggccgtggccgagggcgccggtcctgcgggggacggcgccacggtggcggccggagtgccggccccctcggcgggcttcgtggtcgcggtcggcgaacctgcggccggggagggcacggccgaagcggcggcccggggggcggccggctgctcgtcggcggcgaacgcgctggtgaactccgcggtggccagggtcgccgcggcgatcacggggacggcggcgagcagcaggatgcggcggtggggcgtgagcacggcagggccgtcctttcgggacgatgcgggcgcggaaggccgaagatcgggggtgcgccggggcgggtggacggctgccctgcaggagcagctgtcaggccggcggacacggcgcgcggtgaagcggtggggcggtgaagttcgggggccgcgacggggcggcggtacgcgctgctcatgggcagcggtacgggctactcccccggcggcgggaccggctactcccaggcggtggtgttcttgccgaccggggcggtctgccacgcagtggtggcggtgacccgggtggcggcggcgccgtcggctccgtgggcggcaagggccggggtgatgacggcggcgagggcagcgaccgcggcggccttggcgaggtgggtgcgaagcatgggagtggtcctttgcgagagctgcgatgcgtggctgttccggtctcgcgtcccgcggtgacgtttcgtccggtgttgccttctggggtgttcccttccggcgatcactactttcgtcgcagctcagggtgggtggaagggatttcagctggacgaaagcggacctggacgaattcgtccagccggtccggaagaggccagcaggagctgctcgtagtacgacgtgaccagaggtgcgccgacccgcccgacggtccagccccgcagagccggcacctcgtcgagggcgcgacggcagagcgcctccgtacgccgttccgccgtgtgcaggctgtccgcgatcagatatacgccgaggatcggatccggcagcacgtgcggatgcgtggaaacgtgctccactggaccacagccgccaacgctgccgccctcggcatcggcatcggcgagcgcacggacgagttcgcgcgtgtgcggcgggagttgaacgcccgctgcaggagcgcggagggtggcgtggatgagatacatgcacgccactctcccgaacacttcacatcgggcgaatagcacgaagctggacggttgggtccttgaccggaatcggccacggacggactccttgccccccgccgaacaccacgtgggatgatctccatgccttgactgacgaggtgtacacaggggggggaaccgctgtgctggcagcacttggcctcgacgcgaccgcagaggccgtctaccgcaccatgctcgcgcgcccgcgcgacggagtgcacgctcttgccgaccacctcggcacatccgaggcggagatccggagcagtctggacctgctcagtgagctggccctgatccgcccgtcctacgaacgggagggagagctccacgccgtcccgcccgaggtcggcatggagatcctgatggcccgccagcaggcggatctcgcggctcagcaactgcgcatcgaggcatcgcgcgcggccgccgcccagctgatcgcggagttcgccgatctgagcccgaccgtctccagccccggcgtggagcaactggtgggcctggacgaaatccgaacccggatcagcggcctggcgcacggggtccagaccgatctgatgaccttcgcgcccggcgggggccaccggccggagaccctggaagcctcgaaggcgagcgacctggccctgctggaccgcggggtacggatgcggtccctgttccaggacagcgtgcgcaacagccagaccaccgtggcctacacgacgtggctgggcaagctcggcggagaggtgcggaccgctcccgacctgccgacccggctgatgatcttcgaccggaccaccgccgtcatcccggtcagcagcgacgacagctcggcgggcgcggtggtcctcaccggccagggcaccctgacggcgctgtgcgcgctcttcgagaacgtctggtcgaccgcacagcccctgggcgcatccccggaagagcggcaggagggcgggctcagcccgcaggagaccacagtgatccggctgctggcgcagggactgaccgacgaggcgatcgccaagcggctcgcggtctcgccccgcacggcccgacggctggccaacggcctgatggaacagctgagcgccgcgagccggttcgagttcggcgtccgcgcggtccagcgcggctggctccccggcacggaatagagggaccgcccccggcgaccgaaccctcgccaccgggattgccccacccaccccgggtgtgggccaagctccaccgcctggtcctcgacgagctcggcgcccgcggtgagctggactggtcccgctgcgcgatcgactcggtgaacatgcgggccctgaaaagggggtctgacaggtccgaatcctgtcgacaggggcacgtatcgagtcctcacagcgactgggccgccgccgctggaccatcgaacgcaccatggcctggctcgccggctgccgccgcctccaccgccgctacgaacgcaaagccgaccacttcctcgccttcgccagcatcgcctgcaccctcatctgctaccgaagactcaccaaatgagatgacctctcagggcccggcccgcgcccggtccgtcgccggcgcgggagctacggggcggccgccttggtgagcaccagggacggcgccccgtccggatcgggctggaagtccaccgtgagcgggcctctggagagaagcccttcacggccgttcacatagagctggatgtcgccggccttaccgagctcgccgtccttggccgtcaggtagacgaaggcccggcccgcgtcgatcgacgtgccggtgtcgacgaactcccatcggccgctgaagtcgaggggagcggtgtctccacccccggtggcttcgtccgccgagatgtcagtggcggagaacgttccgtcggacttgagctggatctcgccgccggtctcctcgttgcggtacacgccgggcagctcgtcgggctcggccggggccgcacaccccgacgtgagtaccgcagaagccgtcagtgcggcaacgagccaccgtctgcctgtccccctgatgatcacgtccccagggtaagggccgttacgcgttccaagatccttccaggggctgccggtgaggggccggccgggtgcggaaactgcctggctgccgtgttcggggtgccggtatcgtccggtctcccgacccgccgaaccggcgggcgacgtacagagagcgacgcacatgaccagccggacggcaacgacgaccctgtggcgccccaccggccccgaggagctggatctggtgcgtcagctgaactggcgtgcgtggccgccgcggctccccgagcagccgatcttctacccggtcctcaacgaggactacgcgatcaggatcgcgcgggactggaacgtgaagcacagcggcgtcggcttcgtcacccgcttcgaggtcgcgtcgcagttcctgacccggtaccccgtccagcaggcgggcggccggacgatcctcgagctctgggttccggccgacgagctggacgacttcaacgcccacatcgtcggcgagatccaggtcgtccacgagttccgctgaggccggagggcccgctgagggcccaggtgcagaccgtagggtggccggaactcatccatgacgggcaggaggccgcgatgaccgaggcgaccgggacgacggtggagcaggtcatggccgagctggccgcactggaggatccgaagacgcgcgcggtgaacgagcggcacggtgacgatcacggagtgaacctcaccaagctgcgcgcggtcgccaagcggctgaagacgcagcaggacctcgcacgcgagctctggcggaccggtgacaccgcggcccggctcctggcgctgctgatctgccgccccagggccttcgagcgcgccgagctggacaccatgctgcgcgaggcccgcacccccaaggtgcaggactggctcgtgaactacgtggtgaagaagagcccgcactccgaagagctgcgcctcgcctggttcgcggaccccgatccggtgatcgcgagtgccggctgggcgctgaccaccgaacgggtcgcgaagaagcccgacggcctcgacctcccggggctgctcgatgccatcgaggcgcagatgaaggacgccccggagcgtctgcagtgggcgatgaaccactgcctggcccagatcggcatcgagcaccccgagcaccgcgcccgtgcgatcggcatcggcgagcgcctggaagtcctcaaggactacccgactcccccgaactgcacgtccccgttcgcgcccgcctggatcggcgagatggtgcgacggcagcaggagaagccgtagaggtcctcagcgggacttcttgacgggcgcggccgccagcgcggccttggcgacctccttggccttctgctcgcagccaccggtttgggcgaggccgacccggacgatcagattgccgtggcggacggcgagctcacacgtccactcggtgtcgacggtcctccagtacgccccgtcgccgaacccgaggctgttcacccgcttcccggctgccgcgtccgtggcgaactcggcctgctggagcttcgcgttggcggcatcgccaccaccctgcttgacctcccaccggaccatcgcgatccacttgtcggaggtgtcgtaccaggagcacatcgtcttcgcctcgaagtccttcgcgatgtggaagtcctcctggggatcccgcccggtcagcgggatgttccgggacgcctccggacaggccggcgcgtcggtgtagacggcgggaccgggaccgacgctttccgtcttccggtccagggtggtgtacgcccccacaccggcacccgtcacgaccagcactccggcggccaccagcgccacggtccgcgaccgcctgcgcggcgacgtgggcgacggctcggtcggcgggctcatcggccggggaggaacggggtgcggggcggactcagcgacctccgccgcacgctccaccgactcatcgggttcgtgcgcggactcgggctcgggagcgaactccggctgcggctccggctccgggagcggttcctgcggcaccgccacgtccgccgtccccccggacagcagccggtcgatgtccgcccgttgttcggccagcatccggtacacggcgggcggccactgcaggcctgtcggagcgaccggcccgaggagttcgagcagctgcgccggggtgggcctggctgccgggtccttggccaggcagcgctccacgatcccgcgcagcccgtcgggcaccgcgctcaggtcgggggcggcgtgcaccacgtcgtagagcgtccggagggtcgaggccccggcgaaggggctgctgccggtgaacgccatgaccagcatcgatccgagcgagaacacatcgctcgccggggtcagcggcttgctctcggcctgctcgggcgacatgaaggagggcgaaccgatcacccagccggtgcgcgtcagcccgctgtcgccctcgacctcgtcctcggtcacccgcgcgatgccgaggtcgatgacgcgtacgccgtcctcggtgaggagcacgttgtcgggcttgaggtcccggtgaatcagccccgcccggtggatctccgcgagcgccgacgcgagccccgccgccagccggtggacgacggcttcctccagcacgccgtccgccttgaccacgtccccgagcgagggcccggacacgaacaccgaggccagccacggtgtcggcgcgtccgggtcggcgtccatgacggctgccgtataggcgccggagaccttgcgcgaggccgcaacctcgcgccggaaacgggcccggaagccctcgtcgtcggcgaagtgcgcgagcacctgcttgacggcgacgagccgcccgtcaggccccgcgcacagcagtacccgccccatgccaccctgcccgagcacgccggccaccttgaacggccccacgtgcgtcggaccggccggtcctacgcgctccattcccccgactccctccccgtcgtcagggagcggatcataccgagagggatttcacgaaggcctcgaacgccgccgggtggacggtgaagacgggaccctcggggttcttggagtcccgtacggcgacgcggcacggctgagtggcgacctcgacgcactcgccacctgtgtccccgctgtacgaggccttgagccagccggtgtcaccgagcggcgcgcactcgacgcactgcccgccagtgtcagagctgtacgaagacttacgccatcgtgcgcccgtcaggttctggatgatctccatagcgttcctccattactcgggcgatccggaccgccgatgcctctacggagagcgcggcagcctgcaagtgatcgtaacggagcgaaccttccctgagagcctgaggattggccgtcatatgaccctgcacgaagtcctcggtgtagacgagatccgggtcgccctcgaaccgcatgagactgaatgagcctggctgccccgcatgggcgcctgcctcgaaaggcaggatctgcacctgcacccactgccgcctctgctgagccaacaagtgggcaagttgattccgcatgacctcccggccgccgatctcctggtgcagcacggcctcgctcatcaccacccacatcagcggcggattctcgcggtcgagcactcgctggcgctccatccgggcggccaccttcacatcgaggtcgccctcactccacacccccagcaccgcccgcgcgtacgcctccgtctgcagcagcccatccaccaactgcgcctgataggtggagagataggtggcccgagcttccatctctgcatacgcctggaaccacgtcggcagcacgctccgcagcaccagtcccaccagacgcgagaacaccccgccggtattgagggccgcgtccacccgctccgagaaatcccgggtcgggacgcgcttcgtcgtctcgatctggccgaccagggagcccgtacagaagatgatctcgcccaactgcgcctgcttcaggcccgcctgctccctcaggcgccgcagttcgtacccgtagaagtccagcggcgaggcgctgggatcgagctcgcggatcttgaccatgaggtggtcacccccaagttcacgctgtgcgttcggcgttcgttccggcctgtcgccgagcgtaatcagccggatgcgcccgatggcgggaatcacgcactcggtcgcggtcggtcagaagcggtcgtcagccgttccgcgcgtatgcggcgataatgctctgccgaattgatcttggggtgacgggggcctggcaggtgcgggaagtgatcgaagaccggtacgcgctggccgagttgctcggccggggcggcttcggcgaggtgtggcgggccgaggacagccgggtgggccgccaggtcgccgtgaagatcggatatccgcagacgccggaggacacccgccgcttcgagcgggaggccagcctcgccgggaacctcgcgcaccccaacatcgccaccatccacgacttcgggcgcacggaacgcgaggggcgcgacgccgtctacctcgtcatggagctgctccggggccgcagcctggccgacgtactggaagccggcgtaccgccgctcgcggacgccctggagtgggccggacgcatcgcggacgcgctgggggcggcccacgccgccgggatcgtccaccgggacgtcaagccggccaatgtgatggtcaccgacggcgggctgacgaaggtgctcgacttcggcatcgccaaggccgggagcgccgccggagccgtcaccacgacagggctgacggccaccggcatgatcatcggctccttcccgtacatggcccccgagcggtggaccggcggggcgaacggcgtgcccgtcgacgggcgggccgacctgtacgccctgggctgcgtgctgacggaactgctgaccggcacccgccccttcgccgcgcgcgagatgcacgagctgctcgcccagcacctcacgaccgcgccgcccgcgccgagttcgctgcgggcggggctgccggccgcgctggactccctcgtactggagctgctcgcgaaggacccggcggaccgccccgcggacgcggccgaggtgtcccggcggctggcggagatcgcccggagcgaggcccccgcgcccgtacctgcgcccgtaccggcacccgtaccggcggggtccttcccgcccccaccctcctacgcgcccaccgtgcacaccgcggccgccgatccggtccgcgcgatgctggagcgccggctgacacagctgctggaggacgaaccggccgacgtcgtgcaacggctgcgcatgctgaccgacgacctgaccgaggagctcggcgcgcaggacgccctgacggtgcgggccgcctaccaccgcgcgatgcgggtcgccgggccgtccaggacgatcgatctggagcgcctgctgccgcgcatggtgcgggtcctgggcctggagcacccggacacggtcaccgggcgcgccgcctgggtcggcgaggcggcggccttcgggcccggggacggccgccggcacgagcaggagctgcgcgagatcgtcgagcaggcgacacgggcgttcggcacgcacgacctggtcacgctgaccgcccgctaccacctcgcgtcggctatgcaccggggcgcccacgcccgcgacggccagtgggacgcgcgcagccgggagcgcgcgctgagcgagcgcgcctggctggggccactgctgcccgacctggaatgggccctgaccgccgacagtccggtcctgctggacgtgcggcgcaggctggcccacgacgcctggctggtcggtgacaccgccggcgccgcgctcctgtactggcggctcttcccgaacctcgccgagctcgccgagcgcggcgatccggaggtggcccaccgagtgctccgcaccatcggcgaggcgggcgatccggcggccgccctggcgcacctgaacccgctgctgcgccggatccccttcatccccggcaagcaggacctggcccaggaggtctccgacacccgggcggacttccggcgtgccgtacgggagcagcggcgggccgaggggacgggcggggcgggcggcctgtcccggctgttcggccgctgaccgcgcggcggcgtacgagcgcacccccggccgtagcgtcctaccagcgggtaaggcaccatgggccgccacacacgatcaccgccggaggaaccatggccacccccaagccggagaccctcgccgccttcgaggccgccaaggggttcatgcccgtacgcgagggcctcgccctgtacgaggcggccgccgcggccggggcgctcgggctgccgctgctggaggtcggtacgtactgcggccgctccaccatcctgctcgccgacgccgcccgcgaggccggcgtggcggcgatcaccgtcgaccaccaccggggcagcgaggagcagcagccgggctgggagtaccacgacccgacggtcgtggacccggaggtcgggctgatggacaccctgccgaccttccgccggaccctccacaaggcggggctggaggagcacgtgatcgcgatcgtcggccggtccccgcaggtcgcggctgcctggggcggcaagctcggcttcgtcttcatcgacggcggccacacggacgagcacgcgagcggcgactacgaggggtgggccccgcacgtcgcggagggcggcacgctcgtcatccacgacgtcttcccggacccggccgacggcggccaggccccgtaccggatctacctgcgggcgctggcctcgggagccttcgaggagatctccgtcaccgactcgctgcgtgtgctgcggcgcacgggcgccggcatctgagaaccgggggcacgctcaccaggccggtcatccgacctgatgaacgccgggcagacaatcacaccacgccttcggatggcctacggtccggccgagcccccggagccgggtctagcatcgcggcgtgcgcaacgacaacagccccccgccccccgagtccggctcccccatcggcccggaccggccctggttcacccgacgctccacgctcgtcgtcggggttgccgcgctcgccccggccgctctggcgggctgggtcctgacccaggccttcgccgggtcggggtccgacgggcagccccgctcggcgccgctgtccgcctcgcactcggccctgtcgccgggccagcgggacgcgaagccgggcgccgccaccgatgaggacgcgaccgcgagccccggtgccggtacgagcacccccgcggccgcgcccgcacccgcacccgcacccgcacccgccaagggcgcgctcgccggccggaccgtggtcgtcgaccccggccacaacgccggaaacttcgagcacaccgacgagatcgaccagcaggtcgacatcggcacgggccacaaggagtgcgacaccaccggcaccaccaccaacgccggctacaaggaggcggacttcaccctcgacgtctccctgcgcctgcggaccgccctggaggcccagggcgccaaggtcgtcctcacccaccaggccgaccgcccgtgggggccctgcatcaccgagcgcgcccgcatcggcaacgaagcgaaggccgacgccgtcgtgtccgtgcacgccgacggggtctcggcgggcaaccgcggcttccacatcatcctcccagccaaggtcaagggcggtgccgccgacaccgcgaaaatcgtcgaaccgtcccggcagctcggcgagcggatcgccgggaacttcgcccgcaccaccggatccgaccccgccaactacctcggcagcggcacgggtttggtcgtccgggacgatctcggcggactgaacctgtcaactcagcccaaggtgttcatcgaatgcggcaacatgcgtgacgccaaggacgcggcgcagctgacgagtccggagtggcggcagaaggcggcccagggcatcgcggacggcatcgtcggcttcctcggcgggtagaccccctcgggagtccggcgggaccacccgccgacccgatcatctcggccgtcggaaacctccgtaccatggtgcagcccgccctgctgcagacacgttctgcgaccgtggcaccacgagacgacgaccgagaccgagaaggacacctgagacgtgaacatccgctccctcactcgaggcgacggcgtggtgatcggagcagcggcgctgctgttcatcgcctcgttcctcgacttctactccgccaccggcgtcgaccggccgagcccgtgggacctcagctccaaccacctgacgctccccagcatcttcctgctcggcttcatcgccgccggtctgctgatcgcggcccgcttccagcccgagcgcaagctggccggcctgccgctgacggcgtggggcaccgtgctcgccgtctccgccgcctggtcgtcggtgtgggcgctcatcgcgtgcccggagattttcgacctgggcgcgggctccttcctcgccctcatcgccacgctggccctggccggcgtggccgtggccggggcgaaggtcccggccctcgccggccagctcgttccggaaccgcggcccgccgcggtcccgccgtacgggggccagccgggccagccccagccgggtgccgggtacggctacccgggcgggcagcagaccccgtacggggccacgccgcagccggtcccgccgtacggcggcacgcccaacccgaccccgggtcccggtccgcaggactcccagcagaccccgaccccggccccggcggcggacttcagcccgttctggttcgcggtgccggtcgcccgccccctgtacgcggaggacggctcgccgtccccgatcgccgaactcgccccgggcacctggtacctggctgtcgagcagcgtggcgcggccactctgatcgcccagacccaggacggccgccgcggcgtcctgaacgacacctccggcatccagcgcggctgaccgccacccggatcccggccgacggccccccgcccttccgggcggggggccgttgccctacagtcacctgacgcctcgtcagattctggagggaccgtacatgcgcctcggactcgccctcggctactggggccgcggccccgcccccgcccacctcgacctcgccaccgaggccgagaacctcggctaccactccgtatggaccgccgaggcctggggctcggacgccttcaccccgctgacctggatcgccgcgcacacctcgcggatccgcctcggcacggccatcgcgcagatggccgcccgcaccccgaccgcgaccgccatgcacgccctgaccctggaccacctctccggcggccggatgatgctcggcctcggcctgtccgggccgcaggtcgtcgaaggctggtacgggcgccccttcccctccagcccgctcaccgccacccgcgagtacgtggacgtcgtccggcaggtgctgcgccgcgaggccccggtggagctcgacggccgcttccacagccacccgtaccgcggcgaggacggcaccggcatcggcaaacccctcaagccgatcacccaccccctccgcgcggacctccccctcctcctgggcgcggagggcccgaagaacatcgcccagaccacccggatcgccgacggctggctccccctgtactggtccccgacccgcaccgacgtctaccaggcctccctcaccgacctccccgagggcttcatgatcgccccgatggcccgtgccaaggtctgcgacgacgtcgcggaggggctgctcccggtcaaggcgatgctcggcttctacatcggcggcatgggccacgcggcccgcaacttccacgccgacctgatggcccgcatgggctacgaggaggaggcccgccgcatccaggagctgttcctcgcgggccgcaaggaggaggcggtgctggccgtaccggacgagttcgccgacgagatctcgctcgtcggcccgcgggaacggatcgccgaacgcctggacctctggcgcaagggcccggtgaccgacctcctcctgaccgccccggacccccacaccctgcgcgtcctggcggacctcaacagctgaggccgctcgcccggaccgtgcggccaaagggggcggctgctcaggccgtgtcctccgcctgcggtacggcctccagcagctcccgcacatccagcggcatgacggcgatctcgatgctcccaccgccgtcgtaggcacaggtgacgatccgcgagccggggttgatggagatcccctccttcaccgaggggacccgcaccccggtggcccgcccgccgggcagcacgacgacctccccgcgctccggaacccaccgggccacgccttcctcggcgtacacccgcccggcccgccaccgcccctccccggccgggatccggaccatgcaggggatcccgggcacgggcccggcggccgtccgcgcacgatgcttgcgccgcagcagccacccggcccccacggcgccgagcacaaccaccacgatctcgatcacccgcccattgtctcccgttccgggtgcgggtcccgttccgggtgcggcccggtggccgcgcctcaatcgccggcggggctgggtttggctccgggtgggcggggtcgggtccgggggtgggggtgcggggccgccggcgggtgtctcctcggctcgcgcctgcgggcacgtcccggccgtgcggggtggttgcgcgctcgtcctgcggggacaccccccgccgtccccgcacccccaccccggccgaccggcactggggccgtggggtggggacactccgggggctccccgcaggacgagcgcgcaacccgggccgaacggcagaaccacggccgcaggcgcgagccgaggagagcccccggaggggcaccaccccacccgaagccacgcccacgggcccgaccgcccaggggacaccaccagccccgccggcgattgaggcgcggccaccgggccgcaccccaccgcaccgcccggccagggcaagggcaagggcaagggctcgaatcgctagccgcccagctgcgacgcgctcgggaccttgtccgtcaccgtggcacccgcactctggcccgcttccttcacgctgttgatgacgctgtcgaaggcgtcgatgtcgccgtcacccgcctgacccttgcgcagcttgctgccgaggcccttgagggactcgatgcccgccgtgagcggggccaccgccttcgacagcagcgggtcgcccttggcgttctgggccgccgccttgagccggttgtacgcgaaggcgcccgcgaggcccgccttgatcagcgcgaaggtgcggcccttggcgcccttcttgaacttgcccgcgcggtacggcttgacgatccactggtacgtcgcaccggccgcgaggctcgcattggcgacgaagcgcgtcttcgcgaacttctgcttctccgccgacgtggtgggcgacggggtcgcggcggccagttcgtcggcctcggcggcgacgggctccgccgccgcgagggcggccagctcccccatcgacgcggcggagagctcctcgcgcgggccgctgccgccactcccgcacgcggtggcgccgaccatcagcgcggtggacagcaccacggccgtgacggcgcggcggaatcggacggtcgtgggtacggacacggtttcctccgggaatgaggcgtctcccgcagcctcaccccgttccccccgcctccaccacccgggggcgcccgttcgggtttacgacacgccgaggcggcaacacgcgccgtatgagcactcacacacgagtacgcacccggggaagcagtcaggcaggccgtgccgtcgcgctggtggcggacgtgctcgccttcgtcatcggactctggatcctgctctacctgctggaggccaaccagggcaacgccctggtcgacctcgtccacgacgtcgcgtcctggctggcgtcctggtcctacgacctgttcaccttcggccgcgcatgggtccaggtcgtcgtcggctacggcatcgccgccgtggcctatctcctcgtcggccacgcggtcgccggctggctctaccgccgctgaccggtcagcggcagcagtccggctccagcccggccgggagttcggtcccgccgaacacctgggtggtggcctcgtccccgccgagcgccgcgacggcgagcagcagggacccggccgtccaggtggtctgctccaccggccagacggcccggtcctggaacacgtaccccgtccagtacatgccgttgtccgcgcgcaggtgggtgatcgaccgcaggatctccagcgcccggtcggactcccccgtcgcccacagcgcgagcgccagctcgcaggactcaccgcccgtcacccacgggttgggcagtacgcagcgcacgcccaggtccgggacgacgaactcgtcccagcgctcgtcgatgcgcgccttggcctccgagccggtcagcgccccgcccaggaccgggtagtaccagtccatcgagtagtggttcttgtcgaggaaccgctccgggtggcgccggatggcgtgccgcagcgcgcccgcggcgagctcccagtcgggctgcggctcctcgcggtgctcggcgatggccagcgcgcagcgcagcgcctggtggatcgaggacgatccggtgaggagggcgtcggtgacggccgtgccgtccgcctcccgcttccagccgatctcgccgcccggctgctggagcgtcaggacgcactccacggccgcgtagacggccggccacatgcggtcgaggaaggtgtcgtcgcccgtggacaggtagtggtgccacacgccgacggctatgtacgcggtgaagttgctctcgcggctcgcgtcctgcggctcggcggtgtccaccccgtccggccggtcggcgtaggccgcgtaccaggaaccgtcctggttctggtgccgggccagccacgtgtacgcccgctccgccgcctcgtgctcaccggccgcgtccagtgccatcgcggcctcggtgtggtcccacgggtccaggtggtgcccgcggaaccacggtatggccccgtcggcgcgctgcgcggcgaggatccccgccaccgtccgcgcggcctcctcggccgtcagtacgccgtccaggaccaggtgttcggtacgcccgggcgagctcactgggctgccgcgctgacggggaggtggggcttggtcgcgtacgccacgaagctcttgccgatcagcgggttcagggcctgctccgcgagccgcgtggccagcggcttcttcatgatgtcccagaccaggagcttgtggtacgccttgacgggcagcgccttgtcgttgtcgacgccgaaggcgcacttgagccaccagtacggggagtgcagcccgtgcgcgtggtgcgtgccgtacggcttgaggcccgcggccttcatcttgccgagcagctcgtccgccttgtagatgcggatgtggccgccctcgacctcgtggtaggcgtcggagagcgcccagcagatcttctcggggccgtagcgcggcacggtgatggcgatgcgcccgccgggcttgagcacgcggaccatctcggcgagcacgcccttgtcgtcgtggatgtgctccatcacctcggagatgatgacgacgtcgaaggagtcgtcggggaagggcagcgcgagcgcgtcgccctccatggcggtggcggtggccccggcgggggcctcaccggcctccttcatcgctgcgaaccacttggcgacctcgcggatctcctcgccgttgcggtcgacggcgaccacctgggcgcctctccggtagcactcgaaggcgtgccggcctgcgccgcagcccaggtcgagtacgcggtcgcctgcggcgagcgggaaccgggagaaatcgacggtcagcacggggtcctgccttcgcggtcgcgggggttcggggtggtggggaagaagcgggggaagcggaaggtcaccgcgccgagcggccggtacgcgcggcggcggcctgctcgatggcggcgcggtagtgcgcggcggtgcccttggcggccgcggcccaggtgaaccgggtcaggacccgttcgcgcccggcgccgccgaggcgggcccgcagctccggatcgcccagcagccggcccagcgcggcggccagcgcgcccgcgtcgcccgggggcaccgcgaggcaggtctcgccgtcgggtccggcgacctcggggatcgcgccgccggtcgtggcgacgagcggggtaccggtggccatggcttcggccgccgggagcgagaagccttcgtagagggagggcacgcaggcgatctgggcgctgcggacgaggtcgacgagctcggcgtcggtgatgcccttgacgaagcggaccgcgtcctggaggccgtacgcctcgatggcgcgggccacgggaccctgctcggcgcgcttgccgacgacgacgaggtgcgcctcgggctgctcggtacgcagcttcgcgagcgcctcgacgaggtacacgagccccttgagcggcacgtcggcgctggaggtggtgacgatgcggcccgggacctcggcgacggacgggtccggcgaccagaggtcggtgtcggcgccgatgtgcacgacgtggatgcgctcgtcgcggacaccgaggtgctgggcgatctcctgccgggaggatccggagacggtgagcacggacggcagccggcgggccacccggccctgcatgcgggtgaaggcgtaccagcggcgcacggaggcccgcttcaacaggccctgcgcggcgtccaggtccagcttgcggtcgacggtgatcgggtggtggatcgtcgtgaccagcggggcgccgaggtcgccgaggaggccgtagccgagcgtctggttgtcgtggatgacgtcgaactcaccggcgcgcgccgccagatgacggcgggcgcgcagcgagaaggtcaggggctcggggaagccgccggtccacatggtggcgacctcgacggcgtcgatccagtcccggtactcgtcgcgcttcggcgtacggaaggggtccgggctgcggtacaggtccaggctcgggagttcggtgagcgaggcgcccgtgtcgagcaccgggtagggctgcgcgccgatgacttcgacggagtgccccagctggacgagctcgcgcgagaggtggcggacgtacacgccctggccgccgcagaacgggttccccttataggtgaggagtgcgatacggagcgggcggtcgccgtcggcggcggtgcccgcgaaagggctcgtcaccatggcctcagcggtcactctcggcccccttctcgctgcaactttcgccggagcgtaaccgctcggataatgtagaacaagtttcagacttgatccgtcgaagaccattgaatctaccggccggaaaccacaccgtaagaggcggagcaggtgattcgcgccacggctccggcgcctgcgatgctggccgcggaccagcccggattcagcccgcgcaacgacacggaacgggacacatgacagcggaagtgaaggccgtcacgacaccggcgtcgcctcccctgacggaacgccaggaggcacgccgccgccggatcctgcacgccagcgcgcagctggccagccggggcggtttcgacgccgtccagatgcgcgaggtcgcggaagcggcgggcgtggccctgggcacgctctaccgctacttcccctccaaggtgcacctgctggtcgccaccatgcaggaccagctccagcacatgcacaccacgctgcgcaaacgcccgcccgccggggacgacccggcggcccgggtcgcggagaccctgatgcgggccttccgcgccctccagcgcgaaccgcagctcgccgacgcgatggtaagggcactgacgttcgcggaccggagcgtgagccccgaggtggacacggtgtcccggctgaccacggcgatcatcctggacgcgatgggcctggagcagccgcccacggccgagcagctctcggcggtccgggtcatcgagcacacctggcactcggcgctgatcacgtggctttccggccgcgcctcgatcgcccaggtcaagatcgacatcgaaacggtgtgccgcctgatcgacctgacggccccggaaaaggcctgaagccgccgctcgcacggcgaaggccacgcgagcgaagccggaacgcggggcgggggcgctgggcgggggcgctgggcggggcgctggtgagcgggagccgcgcgtgcggagccggaacgcggggcgggggcgccggggaacggaagccacgcgggcggctccggaaggcggggcgggggctccggagggcgggagccgcgcaccccgtggtcagtgatgtgcatgggggtttcccgtcagtctcatcgtctctccgtgtcgggccggtccctcaagggcgctccttcgtcgcgtcgcttcgcgatggccttgcggccacccttgaccgaccgacccgccccggaaatccgaagactgccgagaagcccccaaaagaacgagccgggcactcaaggatcaggacggggcggccagagaccccctgcccggacgggggcgagggcgaccgacaggcggggcccatgacagccgccgcccgcgtcggggggaagcgccccaaatcgctacgcgctcctgacgtctcagcgtccgacgaccgtcctgggctggacataggccgcccacggccccggtccggcgctcgacctgcgtcccacgacgggctggggcctgggcacaagccgcccaccatccagtcattcctcactcacggcggtggacgaccgtccgtggcgggccataggccgcccaccatccgtcggtttctcattgacggcgtccgacgaccgtctgcgcggtcataggccgccgagaactctcggatgctcctctttgccggcgaccgacggccggtgcgcccgcccgggcgcattgagggtcctctttgactgcgtctgactgccgtccggaggtgaaaaggcgtgggactgcggctatttcgtcgtggatacaggtcagcgcacgtgggcgacccaaagtggcgttggtttgccccaattgcccctgtctgggggttggtttctggtgtcgtgttggcgctgacccgattccacgacggaatagtggaggtgtcagccgccagtccccctcagagactctcatcagcccccaaccggccgccggtcgcagtctcggagaagcgcatagcgatttgaggcggctcaatgcccagcgccggccggtcgtcggacacaagtcgggcagcggaccggtctggtgggcggcttgtgcccaggccccggacggtcgtcggacgcaggtcgagtgtcggatcgaggtcgtgggcggcctatgcccagcccaagacggtcgtcggacgctgagagatgaggagcgcgtagcgatgtggcgcgcctcccccgacccgggccggggtctgtcatgggccccgtctcgggagtgtgcccgcccccgtccgggcagggggtctctggccgccccgtccttcaaagcctggaccggctcgttcttttgggggcttctcggcagtcttcggatttccggggcgggacggtcggtcaagggtggccgaaggccatcgcgaagcgacgcgacgaaggagcgcccttgagggaccggcccgacacggagagacgatgagactgacgggaaacccccatacacgtcaccgaccaccgccccagcggaacagcccctccgcagccgccgcccggcttctcgactccgcccgagaggctcccgcacgccgaagcccccgccccgccgaccgaccccgatcgagcgggtcggccccaccgaagcccccgccccgcccctactcctccggtgggaagaccggttctcccgtcgccgccagggtgatgaggatggcttccaccgggcagccttccgctgccgtgagggtcggctcgttcgcgtccgcctcggcggtgcgggggtgggactggcgtgccgagtccaggacgaagccgtccggggcgtggttcacgcacatgcccgagccgatgcagacccctcggtccacctcgacctgccagcggtcacccatcaggcacccgcctcgtggcccgcgggcaggtggatcatcttgtgctccaggtactcgctcaggccttccgggccgaactcccgccccaggccgctgttcttgtagccgccgaacggccccagcatgtcgaggctgaaggtgttcacgttgaaggtgccggtgcggatccggcgggcgaagtcgatgccgtgctcgacgtcggcggtccagacgctgccgctgaggccgaagtccgagtcgttggccacccgtaccgcctcggcctcgtcgccgtaggggatcaggcagacgacggggccgaagatctcctcgcgcgcgatccgcatggagttgtcgacgtcgccgaagagggtgggctccacgtaccagccccgctccaggcccgccgggcggccaccgcccgccaggaccttcgcgccctcctcctgcccgatccggatgtagtccagcgagcgccgctgctgcctctcggcgacgagcgggccgagctgggtggccgggtcgagcgggtcgccgacgaccagctcgccggcggcggccgcgagggcctcggcgacctcctcgtaccggctccggggggcgaggatgcgggtctgggccacgcacgcctgtccgttgttcatccaggccgcggggacgatcccggcgaccgcggtcgccacgtcggcgtccggcaggaccacggccgccgacttgccgccgagttcgagggtgacgcgggtgaggttgcgcgcggcgacctccatcacgcgcttgccggccgcgaccgaaccggtgaaggccaccttgtcgatgccgggatgtccgacgaggtactcgctgacctcgcggtcggcgggcaggatcgagagcacgccctcggggagtccggcctcgcgtgcgatgtcggcgaggatgtaggagtcgagcggcgcctcgggcgagggcttcaggatcaccgtcgaccccgtcagcagcgccggcgcgagcttggccgccgccacgaactgggggacgttccacgggatgacggcggcgaccacgcccacgggctcccggcgcaccaggatcggcccgagcacgccctgccggtactcctcgtacgggtaggcgcgggcgaccgtgatcgcggcgtcgtagaccatcatcgggccgagcgcctgggcgaggatgctccaggagtacggggatccgttctgggagctgatcgagcgggcgatctcctcgtgccggacggcgatcgcgtccttgatccgggagacgacggcgatccgctcgtcgagggtcatccgcggccaggggccctcgtcgaacgccctgcgcgcgacggcgacggcgcggtcgacgtccgcctcggaggcgtgcgggacggatccgatgacctgctcggtgtggggggagacgatccggatcgtgtcggtgcccagcggatccgtccactccccgccgatgaacagctttccgtgttccacgagctcggtcatggctgctgcctcctgcggcttgccctgcggcttggcgttccagaactgataccagttctagttagaggagtccacggccaggacggaacctccgtcgcagccacgcggaagatcgaacgactagtcagggagcccggaaagtggtcgacttgggctactactggaacacgttctcgtccgagggcggcaacaggggagggcgggcgcatgacggaggacacgccacagatcacggaggacactccacacgtcaccgatcacggcggcggtgtgtgggggatcaaggtccccatccccgacaaccccctcgggcacaccctggtccacgtcctcgacaccgaccgcggcccggtcctcgtcgacaccggctgggacgaccccgagtcctgggacaccctcgtcgccggcctcgccgcactcggcaccgccgtcaccgacatccacggcgtggtcatcacccaccaccaccccgaccaccacggcctctccggccaggtccgcgaggcctccggtgcctggatcgccatgcacgctgccgacaccgaggtcgtcgtacggacccgcgcctccgagccaggcgtctggttcgactacatgagcgccaaactcgccgccgccggagcccccgaggagcacatcgccccgctgcgcgccgcccgcgcgagcggccgcatgcggaccctgcccgggctgcgcgccgccgtccccgaccgggagatcgtgcccgccgagctgctccccctcgccgggcgccggctgcgcgcgatctggacccccggccacaccccgggccacgtctgcctgcacctggaggaggaccatccggcgcacctccccggcaacggccggctcttctccggggaccacctgctgcccgggatctccccccacatcggcctgtacgaggccccggaggacacccgcgtcaccgaccccctcggcgactacctcgactccctcgaacgcatcggccgcctcggaccggccgaggtgctcccggcccaccagcacgccttcaccgacgcacccgcccgcgtacgggaactcctcgaccaccacgaggaacggctcagcggcctgcggacgctgctcgcggagccgctgaccccgtgggggctggccgagcggatgcagtggaaccggccctgggagcagatcccgtacggctcccgcaacatcgcggtctccgaggcggaggcccatgtgaggcggctggtgaagcagggccgggccgaggcggtgccgggcacggacccggtcgcgtaccgggccctgtaaggggcgcacgcccccggcaccccggggcccgccggttacgggccggtagagtgagcctgtcgtccacacctctgtacggggggaagccggtgcaattccggcgctgacccgcaaccgtgacccacacccggcaccgcccgggcggggagccggaatgccccgtaccggtggtgcgcggctcgtgtcgccggagccccggcggccggcaccgtcgaggtaaacggagccggagcccggtgcctgtgcgtgcctgctgccggttcccccgtacgagaggcaccgcccccctatgaacgtccgccgcagcgcagccgcgctcgccgcctccgccgtgctctgcgtgggcgccgcccccgcagccctcgccgacaccgcgccgcccgcctccccctccgcgccgccggtcatccccgaaggcctctacggcaagaacgaccccacctacgacggcgtgtggcggcagtccttcgcgctgctcgcccagcacacggtcggcgtcaagccctccctcaaggccatggtctggctggtcggccagcagtgccagaacggcggcttcgcctccttccgcccgaacgccggcgtggcctgcgacgcgaacacgatgtacgacacgaacgccaccgcggccgccgtgcaggccctgcaggccctcggcggccacgacgcggaggtcaagaagagcgtcgactggctgaagtccgtccagaacgaggacggcggctggagcttcgtgcccggctcccccagcgacgccaactccaccgccgtggtgatcagcgccctgtccgtggcgggcgagaagcccgccgaggtcaggtcgaaggcgggcaagtcggcctacgagggcctgctccccttccagctgggctgcaccgccgagccggccgccgaccgcggcgccttcgcttaccagccggtcgacggcaagctcgtcgccaacggcgacgccacggccgccgcggccctggccggcctcggcaagggcgcggccgtggtcccgtccgccgagaacacccccgccgccccgctggcctgcccggccgtgaacgccgccgacccggtggccgccgcccagggcgcggccggctacctggccgaggccctgaagaaggacggccacctcatggccgtcaccccgggcgcggaccagcccaccccggacaccggcaacaccgccgacgcggtactggccctggccgccgcgggacacaaggagtcggcggcgggcgcgctgaagtggctggaggccaactccgccgagtggtcgaagggcagcccggccgctctgggcacgctcgtcctcgccgcgcacgcgaccgggaccgacccgaagtccttcggcggcaccgatctcgtcgccgccctgaacgcgaccggcccggccccgcagggcgcggacaccgaggcgactgaggtggagggtgagaaggagaagtcctccaccaaccagaacgtctggtgggtcgtcggcgcgggtgcggcggccggtatcggcatcggcatcctgctgagcggccgccggaagaagaaccagtcctgatgcgccgccgcctgcccgccgtggccctcgcgctcgcgctcgctctcgggatcgggatcggcgcggccctgtcggcggccgctccggcgctggcggccggctaccgctactggtcgttctgggacggctcgggtggcggtcagtggtcgtacgccaccctgggcccctcgatggcccgccccgcggacggcgccgtccagggcttccgcttctcggtgagcaaggacgcggcggcgcaggcggcgcagccgcgcgcggcggccgacttcgagaccgtctgcggggcgaccgccccgacggcgagcaggaagcgggtggcgctcgtgatcgacttcggcgtcccggcggacgccccggcgggcgacgccccgcccgatgccgccccgcgcacggcctgtgcgcaggtggcccccgaggcgacggccgccgaggccctggcctcggtggccaagccgctgcgctacaacagcgcggcgctgctgtgcgcgatctccggctacccgaagcaggggtgcggcgaccaggtcgcggacaccgcggccgagtccccggcctccgccgcggccccggccccggcgcggtcctcggaggcggattccggcgggggtccgtccgcgggcctgctggcgggcatcgccgcggtggccgccctggccgcggccggcgtctggcagtcccgccgccgcacccgatgactccccgccccgagccggatcccgcctccgccgacggcgcggtcggcgaagccgcccccgcggcggccggtcccggaacggcccggcccgcgcggcgctcggcccccaccgggcccgcagccgacggcgtgcccccggcccggcggagcccggccggggcgccggacggcccgggccggtcgacgtacgagaaatggcggcccccgcaggcgacccgtgccaccgccctgcacgccggggcctggtggctgtgggccctcgggctcgccaccgccgcctcccgcaccaccaacccgctcctgctcgggctgatcgtcggcgtcgccgggtacgtggtcgcggcgcgccgcaccgacgcgccctgggcccgttcctacggtgccttcctcaagctcggcctgttcgtcatcggcctgcgcctgctcttctccatgctcctcggctccgccgtccccggctcgcacaccctcttcaccctccccgagatcccactgccggcctgggcccagggcatccgcttcggcggccgcgtcaccgccgagcagctcgtcttcgccttctacgacgggctgaagctggccgcgctcctggtgtgcgtcggcgccgcgaacgccctcgccaatccggcgcggctgctgaagtccctcccggccgccctgtacgaggccggggtcgccgtcgtcgtcgcgatgaccttcgcgccgaacatggtcgccgacgtcgtccgcctgcggaccgcccgccggctgcgcggccgccccaccggcggggtgaaggccgtcctccagatcggcctgccggtcctggagggcgctctggaacgctccgtcgccatcgccgcgtcgatggacgcgcgcggctacggccgtaccgccgaggtcccgcccgccgtccggcacaccaccaatgccctcaccgtcggcggcctcctcgggatgtgcgccggcacgtacgggctgctcgccgcgcagggcgccgcgtacggactccccgtgctcggcgtcggcgcggccctggccgtcgcgggcctgcgcctcggcgggcgccggtcggtgcgcacccgctaccggcccgaccggtggggtgtgcgcgcctggctggtcgccggttccggggcggccgtcgccggcctgctcatccacgccggaagtgtcgctccggccggtctgcatccgggtgtggtcccgctggtggcgcccacgcttccgctgtggccggcggccgcggtgctgatcggcctgctgcccgccttcgtggcacccgtaccgcccaaggaggcgtcgcagtgatccgcttcgagcaggtgtcggtcacctacgacggcgcctccgccccctcgctgcagggcgtggacctggagatcccggagggcgagctgacgctgctggtcggcccgtccggggtcgggaagtccaccctgctggggaccgtgagcgggctggtcccgcacttcacgggcggcaccctgcgcggccgtgtcacggtcgcgggccgtgacacgcgtacgcaccggccgcgggagctcgcggacgtggtgggcacggtgggccaggacccgctcgcgcacttcgtgacggatgtggtcgaggacgagctcgcctacggcatggagtctctgggcctgccaccagcggtgatgcgccgccgggtggaggaggccctggacctgctggggctgaacgagctccgcgaccggccgatcgcgacgctgtccggcggccagcagcagcgggtggcgatcggctcggtgctgaccacgcacccgaaggtgctggtgctggacgagccgacgtccgcgctggacccggcggcggccgaggaggtcctcgcggtcctccagcggctggtccacgacctgggcacgaccgtgctcatggcggagcaccggttggagcgggtcgtccagtacgccgaccgggtcctgctgctgccgtcgccgggcgcggccccggtcatcggcaccccggcggagatcatggccgtctccccggtccatccgccggtggtctccctgggccgcctcgcgggctggtccccgctccccctgtcggtccgcgacgcccgccgccgggccgctccgctcctggcccgcctggccgcccccgccgctccccgggctctgcccggaaccgggccgcggacgtcggcaaggccgaagttcccggccccgccggcgcttgaggcgcgtgggtccgggagtggagcccccgttgccggagcgcccggtgccggagcccccgggctcctcgcgcggctgttccgccgcggcgggccgggccccgccaccgcgcaggcccccggctcgggcccggccgaggtccgtgacctctccgtccgccgcggccgcgtacaggccctgcacggcgtcagcctcaccgtggcccccggcgaaaccatcgccctcatgggccgcaacggcgccggcaagtccaccctgctctcgaccctcgtcggtacggtcacccccaccaccggcgaggtgaccgtcggcggccgcaccccccaccgcacgccgccgccggagatggtgcgccgtgtcggcctcgtcccgcaggagccccgcgacctgctgtacgccgacacggtctccgccgagtgcgccgccgccgactccgacgccgccgcaccccccggcacctgccgcgacctcgtgtccgcactgctcccgggcgtccccgaccacacccacccgcgcgacctctccgagggccagcgcctcgcactcgccctggcgctggtcctgaccgggcgccccgccctgctgctgctcgacgagcccacccgcggcctggactacgccgccaaggtccggctgatcgagatcctgcgcggcctggccgccgacgaccacgcgatcgtcctggccacccatgacgtggagctcgccgccgagctggcccaccgtgtggtgatcctggccggcggggaggtcgtcgcggacggtccgacggccgaggtcgtcgtctcctcgccggccttcgccccacaggtggcgaaggtcctggccccggagccctggctcaccgtgcgccaggtcgccgaggcgctcgacgcggcggaggcccggtgagccccgcgagcccgacgagccccgcgagcccggcaagcccggcgagaggtccggtgaagaggcccgtccgcatcggcccccgcgccgccgtcgccctggtcctcgtcacgctcatcggcgtcgcggctttcggctggccgctcctcgcggaccgccagtcgggcctggcccactcccaggacgccccctggctcttcgccgcgctcctcccgctcctggtggcggtcgtcgtcgcgaccatcgccgacgacggcatggacgccaaggcggtggcgatgctcggcgtcctcgcggccgtcggggcggcgctgagaccgctgggtgcgggtacggccggcctggagcccatgttcttcctgatggtgctcagcgcgcgcgtcctcggtcccgggttcggtttcgtcctgggctcggtgacgatgttcgcctccgccctgctgacgggcggggtcgggccgtggatgccgttccagatgctggcgatgggctggttcgcgctcggggccgggctgctgccgggcgcggagcggatccggggccgggcggagctgctgatgctggccgcgtacggcttcgtgggctcgttcgcgtacggcacggtcatgaacctgcagggctgggtgctgctgcagggcatggggcagggcatctccttccaccccggggagccgctgggcgcgaacctggcgcggttcgccgcgtactgcctggcgacctcggtgggctgggacctgggccgggcggcgctgacggtcgtcctgacgctcacgctcggggcgaccctgctgaaggcgctgcgccgggctacccgcaaagccgccttcgacgcgcccgtctccttcggtccgggagccggaatcgaacgcgaacccgctcccgaaaggggtacgaacggcagcggagggtgacattcggggcctcccccggtgacccgtcccatagggcccacgtcacatacgagggctgctagtaggcccgggagccccggaacccacccccacggggggtccgtgggccgctcgctgcgagggccgctagtaagagggacctttgccagggcgacggggcgtctgtagaactggatgagtcgcaaggcggcaggggtacttcacccgccgccgacgaacccctctccaccgcgtgagtggctcacgcatgccttcggcatgccgcgaccatccttgtccccgtcgaaaggtccatccgtgtccaacgccatcatccgccgcatcgccacctccaagaaggccctcgcgggcaccgtcgtcgccctcggtgtcgccggttccatgcttgccacggtccccgcccaggcggccccggcgagcgccaaggcgatcgcacagcagatgatcaaggacccggcccagttcgccgccttcgacaagatcatctcgcacgagagcggctgggactacaccgcgaccaacgcttcctccggcgcgtacggcctggcccaggccctgccggcgtcgaagatggcctccgcgggtgccgactggaagaccaacccggccacccagatcaagtggggcctggactacatgaacgaccgctacggcagcccggtcggcgcctggaacttctggtccgccaaccactggtactaagccgtccgcggacagccgacagctgacggccgcaaccgacagcaggcagcaggcagcaggcagcaggcagcaggcagcaggcagcaggcagcaggcagacatacgaaggccccggtggccggcctccccaggtccggcctccggggccttctgcatcccatcccacgggtctcagcggcgcctcacaggcgctggatgatcgtgccggtcgccagcgcgcctcccgcacacatggtgatcagcgcgaactccttgtcacggcgctccagctcgtgcagcgcggtggtgatcagccgggcgccggtggcgccgacggggtggccgagcgcgatgcccccgccattgacgttgaccttctccaggtcctggtcgaagacctgcgcccaggacaggaccacggaggcgaaggcctcgttgatctcgacgaggtcgatgtcccgcagcgacatcccggccttcccgagcacggcacgcgtcgcgtcgatcggcccgtccaggtggtagtggggatcggcgccgacgagggtctgggcgacgatccgggcgcgcggcttgagtttgagggcgcgtgccatcttgcgcgaggcccacatcacggcggcggcgccgtcggatatctgcgaggagttccctgcggtgtgcacggcggtgggcatgaccggcttgagccgggccagcgcctccatgctcgtgtcccgcagcccctcgtcccggtcgaccagacgccacatgccctgcccggcggcctgctcctcctcggtcgtcggcacctgcacggcgaacgtctcgcgcttgaaccgctcctcggcccacgcggcggcggcccgctcctgggagaggagcccgagccggtcgacgtcctcgcgggacagaccccggtggcgggcgatccgctcggcggcctcgaactggttgggcaggtcgacgttccactcgtccgggaagggcttgcccgggccgtgcttggatccggagccgagcggcacgcggctcatggcctcgacgccgcatgcgatgccgatgtccatgaccccgccggagatcatgttggcgaccatgtggttggcctgctgcgaactgccgcactgacagtccacggtcgtcgccgcggtctcgtacgggagccccatggcgagccaggcgttgcgggcggggttcatcgactgctcgccggcgtgcgtgacggtgccgccgacgatctgctcgacgcagtccggctggattccggtacgcgccagcagttcgcggtaggtctcaccgagcaggtaggcgggatggaggttggcgagagcgcccccgcgcttaccgatgggggtgcgtacggcttcgacaatgacgggttccgcggccatgagctcgtcctctcctgcactgcgtcagcacggcgggccgtcccggcgccccgccccgaactagtacgcgttctagttctccccgcagtcttatgacctgaggccccggcacgcaagggtcttgcacgcggcctgcacggattccacacgcaacagttgacgccaggacccttgtcacttctagaactcgttactaccttcaagccaacttctgatggtccgtcagactttggagttgcccgatgtcctgccccgcactgcccgaaggcttcgacgccaccgaccccgacctgctccaaagccgcgtccccttcccggagttcgcgcagctgcggcagaccgcacccgtgtggtggtgcccgcagcggcggggcgtcaccggttttgacgacgagggctactgggccgtgacccggcacgcggacgtcaagtacgtctccacgcacccggaactgttctcctcgacgacgaacaccgcgatcatccggttcaacgagcacatccagcgtgatgcgatagatgcccagcgcctgatcatgctgaacatggatccgccggaacacacgcgcgtacgccagatcgtccagcgcggcttcacgccgcgggccatccgcggcctggaggaggccctgcgggaccgcgcccggaagatcgtcgaggaggcggcggccacggcggccgacggcagcttcgacttcgtcacgcaggtggcgtgcgagctcccgctgcaggcgatcgccgaactgatcggcgtaccgcagaaggaccgcgcgaagatcttcgactggtcgaacaagatgatcgcctacgacgacccggagtacgcgatcaccgaggaggtcgggtccaacgcggcgatggagctcatcggctacgcgatgaacctctccgcccagcgcaaggagtgcccggccaaggacatcgtcacccaactggtggcggccgagggccagggcaacctcggctcggacgagttcggcttcttcgtgctgctgctggcggtcgcgggcaacgagaccacgcgcaacgcgatcagccacggcatgcacgccttcctgacccaccccgagcagtgggagctctacaaggcgacccggccgacgaccgccgccgaggagatcgtccgctgggccaccccggtggtgtccttccagcgcaccgccacccaggacaccgaactgggcggcgcgaagatcaaggcgggcgaccgggtggggatgttctactcctccgccaaccacgaccccgaggtcttcacgcacccggacgtcttcgacatcacccgcgaccccaacccccacctgggcttcggcggcggcggcccgcacttctgcctcggcaagtcgctggcggtgatggagatcgacctgatcttcaacgccctggccgacgccctcccgaacctccacctcacggacgcacccccacgccgcctgcgcgcggcctggctcaacggcatcaaggaactccgcgtcacccacacctgaccgcccccccctgaactcccgccgccacccctcagccccgccgcgcctcttccaacctgggggccgagtaggaacggcccaggaaaccggtgttggtgtcagaagttttgacaggcagtccgaaggtcgtgccgacgacgttcgagccggagtcgaggctctggccgccgagtgcgacgacccagcgcccgcatcccgcgaggtgtgaaggccgataccaccggattcggacgggcggcctgaagtcgaccgcgcttgccctcccgatcgagcgggggccacggccgcacgccgtgtcactgtcagaaacgaacctttcccggagcaagatcgaaaacggtcgacgggagcggcccggaccgccgatccgccgtcaaaacccgctctcactcaaaagtggaacggagcacgttccgggaatggtttgtgacacgatccggggtcatgacggatcctcaaaccgcactcgtgtccgatgcggacgacgtcgagcgccatccctgcccgcgctgtaacgcagcgccaggttcaccctgtcgctcgcgctccggagcggtcgccggcacatatcacaccggccgcttcacgaaggtaccccggctcgccaagctcctgcgggtgccgaccccggccgaccgcaatccggggcagccgtggcggcccggcacccccgtgcccgcgccgatcgacccggacaccccgagcgcggacatccgcatcggctacgcccgctgctccaccctgacccaggaactccagacgcagctcgacgcgctcgccgcgaagaacatcccccgggacgagatcttcgccgagaagatcagcacccgggtgcgggtccgcccgaagttcgaggccgccctcgccgccgcgcgggagatcaaggcgcacgccccgcactgccgggtgatcttcaccgtgtacgagatgaagcggctggggcgggacgccgccgagctgaccgcgctcgccgaccatctcgccgcgcacggcctggtcctggagatgctcgccggtccgctggccgggatctacgacccgaccgggcacggccgactgctgttcgccttcttcgccgcgatggcggagacggagcgggagaacatccgggagtcgacgctggagggactcgacaccgcggcccgcaagggcaagcacgggggccggccgccggtcatcaccgacgacatgctccacaccgtgctccgccgccggtcgaacggtgagacggtcgaggagatccagcccgacctgatcatccccaccggcaagcgcaagggacagagcccgagcctgtcgagcatctaccgggccctggccgaacacgagaagcggcaggcgtacccggaggccgtcaccgcggcgcacgccgacttcgccgctcgccagagggtcgggagcattccggaccagatggcggggagcatgagcgcatgatctacacgccgcaccgcgccaagggcgctcccgtgctggggcccttcccgggcaggaagggcccttcggccggcggcccgcgccaggtgaggacgacgacaccggcgtggaagccgaggagccggtcgccacggtgcccgcgccccgcgatcggagcgggcgatgacgctgtggcggcaggtcctggccgcgctcaacgacaccaccctcgatgacgccgaacgcgagcggatcgtggcccgcggcgccgcccagctcgccgcccaccgcgcccccgaggggcaacaggccacccccgacgaggtgatggccaccgccttcagagagttcgcgctcctcatcgacgccgagacggcccgcaccgcgctgcgggccgtcagtacctgtgtctgaacccccgttttgtgtagcctggagccctaatctgggctggtgtccgagggcagagggccgactgctcagcgtgtggggtagacgctaagcacggcgtggtggctcaggtcggctgccgggtccttctcgttctgcggcgcgctggtgtagagggcgacgtcgccggagacgtggtcggggagccgggccccgcccaggtcggcggccgtccccgtggcgaggtcgactgagactggcgtcctggcggccgggccggacgtgccgtacgcgacaccattgttgccgacccccatgaagttcaccccgctgcgagtgtcggtcgcgccgaagcagtagcccttcttggcctggaggtcgaaggccatggtgacggcgacgaggtagcgtccgttgtcgctcagcgcagtcgagcctccctggccgagaattcccgtgctcagtccctcgcaggcgagggtgaagacgggttgcccgccgcgctcgtcgtgcagggcccagacgtagttcatcggcaggcccagtgcggagtaggcctggttcttcgcctgccacgaggcgaccacgtagccgcccttcaccgccatgacctggcccccgctgccgggcatcgcgtcgtcacgcgggtcggccccgtctggaatggtcgcctgccccggccacagctccaccatcttgccgcctccggcggccagctggtactcgcggctcccctgggccagcggggccttgaggtcgccggtggtgacatcggcgacggtgaacgccgaatcggtcttgaagagcactgtgccgtcccccgggtgtgcgatgacgagctctgcaccggggatcttgactgtgcgggccggggccactccggtgccggaggaggcggcggggaacacggcggcgttgacgacgcgcgtgccgtggttgaccacgtccgcgccttcgttgaccgctgcggtgaggaccgcgtagtccttcccatccttgctcgtcaccacgagcttgacgtcgctggcgtcgaactccttggggttctcgccgggcttccacggcgcgctcgcccagcggagggcgccagtggtggcctcgcgtgcttcgacgccgaacgccttcccgtcctcgtaggtcttgaggagcagcaccagtcgcgagttcggggcgacggtcggctgcgtcaggtgctccgactgcatcaccgcccagcccttgccgccgtcgaaggccggcgggacctgtgcccgcgcggcggccggcgcgctcggcgtcgcggatgaggccgaactgccgggcgccgcaggcgcgttgtcctgcggcttgccgccgccccccgaccccgtgcatgccgccagcagcaccatcgcggcacccgccagtgatccgtaccgtaacttcctcaacgttcctccccgccctcggtcaagacacctcgccctgacgctacccgccaaccgccgcgttccgtaggccgatccggcagacctggttcggccctcagcgccaccaaggccgcatagacctgatcggcactcaccggacgaaggcgcgagccatggatccacgcccgagatcggccatcgcggccacctgttcgactcaaagccgttcgttcaccctcggaaactggtactcaactccggtccggcgcgtgggtgacccagacggcccagaggccgttgaaccggccgtgaccacgacgatgcggctcacgcccgtcatcggcgtgcagcgcgccagcagcgaaacggttccgcgccccgagctggagccgatcttcaccgagctcgccgcacggtgggagaccgacggccgcctggtacccggccggccggatgaggagtggacgatccgcgcccgccgctacccctggcccggacgctgaccgcgcggtgtgggcacggcccccaccgtccccgcaccgcacccccaaggaaccgcaggcgcccccgccgccgcgttcccgggctgccggaccgtcaccgtggttgggccccggtccggcagccccagaagtccgccaccccggccggggtggcacgcaacggcgcccggcagcacgaaggccctgacccgctcggggtaggccaggaccttcgtatgccttgggggaagctgacgcggccccgacgccagagcgcggaatcgggggccgcggactgcacagggcccaacgtgggggtccagcccagtgcacgcgtcgccctcgccaacgccgccggcggccggaaggacacggccgacgtcaaccggcggcctgccggttcactgatccagcagcggctactttccgccgcgtgccgaccaccgataggccgggctgctgctggggagtgcccgcgcgggaacgggcgcaagctggaggtatggccgaggaccgcagtagcaccgaactcgccgccctcgcccgccaggccgtcgccactgcgggcgtgctgcggctgctgatcgagcggatgggcgatgtcggctggcgcatgcaggagtacaccgacgaggacctgctcaccgtcgcctccgccttgcgcggcaccgcgatcctcatggcggctgacatcggcgacaccgaccttatggaggagatcaccggccgccggatggtcgagatcgaccctgtcgagtggctacggcagcacggtgacggcggcggcgggccatgacgcgcgccgggtcggttcagcggaggccaaccgggcgctacgtctgcgtgcgcaggtagaggcgggcgaaccgggccgccggctcgacgagcggtgacgccgcctcgacgtctccgagttcttcggcgcggtcctcgaacgatgccgtggtctccagccaggcggcgagcgcgaccgcggctcgcgggtccagtgcggccatgtgagccgcggccccgagtgcctgtgcgtgcgtcgcccgctccggattgtcggggtacgcgaacgaggcgaggatgccgctgctcaccgtgccgtccgggccgacatcctccgggacgaacgcggtcaagaccagcccggctgcctcgtcttggtccaccatccaccgctcgtcggggaactggacggcctcggccgcgcggcgccgcagaagcgccgccgcgtcccgcaacaccctggccatgcctcccgggtcctcccgtccagccgtgcccctctcgacgcgctgggccaccggatcgcgtagccgtcacacgaccggcgccgccgaacctgcccgttcgcgctctctccacgcggccgtacggcagcgccccgagcaaaaagcctggtcagagcgggtgaagtagccgggcgcgaggcggtggccgcacgtcgggcaggtgggcccgcgtcctatcgtgtgggcggccatgaggtccagcgcgcgggcgttacggcggtattgccggaaccaggccgacttgcacgcggtcgagcagtaccggcgccgcggggccgagcccgagggcagcggctcgtggcacatcgcgcaggtccgctgcgtgccagccatacctccagggtcctccccctcggccggactggccagagcaggccattcctcgttgcagcggttccgcctaccagatgcggtgatgatccggaccggaatggaagatcatcgaacagacggccggaggggctgggagcgtcgcgcgcgaggcaagatcaacgatcaaggagcgcgcggtgcccaccaactttctgagcgaggaccaacgacggcgcttcggacgcttcgaccaggacccggacgaggggcagctcgccggttccttcctgctcgaccagaccgcgcggcgccgggcgatggccgccaagggcgccaggaaccggatcggctgggcggtccagctcgggaccgtccgctacctgggaacgttcctggacaaccccgaacaggtacccgccgtggtggtcgactacgtcgccgagcagctgggcctggaggccgcggagttcgccgggtacggcgcgaaagaggcccgctgggaccaccaggagcagatccgcgaggggtacgggtactcgaagttcgagttcgaccagtggttcgcgctggcccgctggatgtaccagcgggcgtggatcggctccgagcgcccgaccctgctgttcgacctggccaccaagcgcctggtcgacaagaaggtggtgctgcccggggtgaccgtgctggaacgcctggtctccggctcgcgcgagcgcgccgagaagcgcctgtgggccacgctcgccgccgcgccgaccgccgagcaggccgccggcttgcagcacctggtcgtcgtcccgccgggcaagcggctctccgagctggaccggctgcggcgctcgccgagggacatcaccgcgcgcggggtgggcaaggccctggaacgctacgaggcgctgaacagcttcggcggcgccgcgtgggacctgtccgcgataccgcccggcaggctccaggcgctggtgcggttcgcgcgggccgcccgcgcccaggccgtctccgacctggctgggaaccggcgcctggccaccctggtggcgttcgccgcggtgatgccgcagatcgccgccgatgaggcgatcgaggtgttcgacctggtgatgggcgacctgatccgctcctccagcaccaagatgaccaagcagcggctgcggacgctcaaggacctggacgccgcggcgatcctgctgcgccaggcgtggatcgcggtgtgcggcacggccgccgaccccgagggcgacatccgggcgatgctcgactccatggacgtcggcccgttccacgcggcggccgacacggtcaagctcctcgcgcaggagcccgacgacggcgccgagcagatgctcgccgcccgctacaacaccatcgcccgcttcctgcccgatctgctcaaggcgttcgagttcgagtccagtccggccggcgagccggtcctggacgcgctcgcgttcgtcaaatccctcaagggacggcgccgccccatccaggcgtgggaggtcccggcgaagttcctcaaccccgcctggcggcgcctggtcttcccgcccccgccgatgcccgtgggcagcgtcgagaagcgcgccctgatcgtcgcctccgccgaggccctgcgcaccgccttgcaccggcacgaggtgtacgtggagggcctgcgcaagtggggcgaccccaacgcccggctgctgaacgacagcgcgtgggaggcggcccgctcccgggtctgcgaggaactcgacctcgacgtcaggcccgatgcgatcctggcgggctggaccgaccggctggatgccgcccaccgcgagttcgcgaagggcctggccgccaacccggcggtgcggatcgagcagcagggcggccgtgatcggatcatcctcaccggtctggaccgcctggacgagcccgcttccctgcgcgagctccacaaggagatcgaggcccggctgcccgccgtcgacctgcccgagatggtgctggaggtcgactcctgggtgccctacctcggcgacttcacccacgtctccgaggccaactcccgcatggacgacctggaactgtccgtggccgccgtcctcaccgcggaggccacgaacgtcggggtcgagccgattgtccacgacggggtcgacgcgctcagccgcgaccgcctgttctgggtcgaacagaactacctgcgggcccagaccctgtcgcgggccaacgcccgcctcgtcgactaccacatgcgtctgccgctggtgcaggcgtggggcggcggcgagctggcctccgccgacggactgcgcttcatcaccccgatccgcaccctgaactccgggccgaacccgaagtacttcggcacccgccggcgcggcgtgacgttctacaacttcctgtccgaccagttcagcggcctgcacggcatcctgatccccggcacccagcgcgattccttctacatcctcgacggcctcctggagcaggagaccgccctgcgcccggtcgagatcacctcggacacgcacggctcctccgagatcgtcttcggactgttccggctcctgggctaccagttctccccgcggctggccgactccggcagcgcgacgctgtaccgggcagacgcggacgccgactacgggccgctcaacccgctgacccgcgacaaggtcaacatcaagcagatcaccagccactgggacgacgtcctgcgggtggcaggctccctgcactcgggcaccatcaaagcctccgaggtcctgcgcgtcctggcccccggcgccaagcccacccccacgggcaaggccatcatggagatcggccgcctggaccgcagcgcctacctgtcctcgtacttcaccgacgagctgctgcggcggcgcatcaacacccagctcaaccggcaagagtcccgccacaacctcgcccggaagatcttccacggacagaagggcgagctcaggcagtcctaccgagaaggtcaggaagatcagctcggggcactgggcctcatgctcaacatcgtgatcctgtggaacacggtgtacatgcagaagatcatcgccgagatgcgcgccgagggcatccacgtccgcgacgaggacatcgcacgcctttccccgctgaagttcgcccacatcaacttccacggccgctacagcttcgcactgccctccgaggtccagggcggccagctccgctccacccgcaagcccgagaccgccggcaccacgatctaggaaggcccggccggctcgtccgacacccgggcgagccggtagcggaccttctcgtgcgacaagcccgcctgcgcgccgatctgccgcagcccccagccctccgcttcgccgcggccatcccgccgtccagggccgcgtccgtcaccttgcccagtgcctcccgcagctggaccaccagccgcagccggatcgcgggcgccagatcatccagaccagcgcagaaccgcgccacgtccgccttcaggaaaccgatcgtcgggtcatcgctcacccgcacaccctgacggcccggatcacggcctgtcaaaacttctgacaccaacaccggtttcctgggccgttcctactcggaccccaacctcgccgcgccccttccagccccgccggcgtttgaggcgcggggtccggggcggagccccgatctttcagcctcgccggcgtttgaggcgcgggggtccgggggcggcgcccccggcaacggcgccgcacccgttcgagtggcggcccaccccgaacggagtgatcctggcaagcagcgacgatccagccgaaggggcgccggggcagcgaatgccccggcgccccttcggccacccccggccctggccaagcccggcaagggcaacggcaacggcccggccagggctacggctcggacggcctccccgcaaccgcgtcgtacacccgcagccgcacccgccgacgccacccctccttctcctcccgcacccgcgcccgccgctccttgcgccccccggcgggataccgcgcccgcgcccacggcgaccccggccgtgccagccgtaccgccccgaccagcgcgaagaacggtacgaggatccccaacagcccggtgaacaccttccccttggccagcgccaccagcgcgaagcccgcgttcaccgcgaccaccgccgcgtacgaccaggcggaggccttcgtaccgctgtccgaggcgtcgtcgacgccgaagggtgacgcccccagcaacagcagcccgcaggccgcggccccgaccaccaccgcgtccacggaaagccggccctcctcggaccagtacacgtccttcaggtgcaggatcagcgcgaactcgtcgagcaccagcgccgtcccgatgccgaacagcgccgcgtcgatctcggcccacgggggcctgttcccggtcggtgaggcgagacccagcccaccgatgatcatcaggatcacgccgaagaccacgtggtggatgtgcagcccgcccggtgtgacgttcttcggccaccaggagacctgcgcccggatcagccgcacgctgatccggatgaacaggaacgcgccgaggaagcccagcagcaggcagagcagcggctgcttgcccggttcgacgatctgacgctggtaccagtcgcccacgggtcaggccgcccgctcgcgtcggtcgggccgggcggcgtgcgcgacccccgtcggctgtgcgctcatgacccgatgctggcaccgggccgggcgcggcgcctgcgggatgaccctcggcgcctgcgcgagggtccgcggccgcgggcccggaccccctacgcgctccgggccggggccgcctccgacctccgctccccctcgcccggcgccccctcgcccgccgccgcctcggcaccccggcgctgcacgggcagggacagctgcagcccccgcggcccggacagcacgtacacgagcgcgaagccggcggacacgaccacggctccgcccacggcgtccagtacccagtggttggcggtggccacgatcgcgcacaccgtgatcagcgggtgcagcgctccgagcagcttctgccagcccttcggcgccagcaccacgatcacgatcccgcaccacagcgaccagccgaagtgcagcgagggcatcgccgcgtactggttggagatcgcggtcatggccccgtaggaggggttggccaggtcctgcggcccgtgcacggtgtcgatgaaaccgaggccgggcatcaggcgcggcggcgcgagcgggtagagccagaagcccgccagggccagcaccgtggccaggcccagcgaggcccgcgcccaccggtagtcgccggggcggcgccagtacagcaggcccaggatcgtcagcgggaccacgaagtggaaggaggtgtagtagaagttgaagaaggcctccagccagggcgtgccgaccacggcgtggttgacggcgtgctcgatgtcgatgcccagcgcccgctcgatgccgtggatctggctgccgttgccctcggcgaggctgcggctggtgggcgcggcggcccggatgtgggagtagagcgagtagcccacccgtatcaggaggagttccagcagcaggttcgggcgggacagtacgcgccgccagaacggcatcagcggcacccgcgcccagcgggccgccgcgggccgcccgtagtcggtgggtaccggttcgcgccagtacgcggacgagcgcggcaggaacggtaccgcgcaggccgcggccacggcggtgagcagcagcacgttgtcccgtacgggggccagcgcggccaggttcggcagcagcatcgtgctcggcagggtcatggcgaggaccacggccaccggccacacgggccggtcggcagcccgcttgccgaccttgccggcgaccgcgagcagcacccacagcagctggtggcgccagccggccggggacacggcgacggcgacgcagccggtgacggcgacggcgagcagcagctggccgtcgcgggcgtagcggacggcgcggcgcaggccggtccagacgatggcggccgcgagggcggcgtagagcaggatctcgacgggtccggtcaggccgaggcgcaggagcgcgccgtgcacggactggttggcgaggccgtcgggggcgccgccgaggccggtaccggccaggtgctggacccagtacgtccaggagtcgcgcggcatggccgcccaggacagcgcggtggctccggcgaaggtcacggcggcggtgtgtgcggtggggcggcgtccggtcagccacagcagcggtgcgaacagcagcagcgcgggctggagcgcggcggcgaggccgacgaggaagccggcggggcggtcgccgggcacgcggaagacggccagcagcaccagcaggacgggaaggacggcggtctggccgggtgaggcggcctcgcggacgggaagcgagaccatcatcagggccgtgagcacgggcgcggcgagcagtgcggtgcgccgtggcaccgggtcgggcaggccgcgggcggcgacgagcccgatggcggcgacgcacaccagcgtcacgcaggtccaggcgacctccagcgacggggcggcgacgccgacgagcggcttgaggaccagcccggcgaagggggtgtcggagaactggccggtgtcgtagaccgatcccggcaggctgcccgggaggtggaagccgttcagccattcggccggtggtacccgcagcacggcggcggcctgtctgacggcgagggccccggccagcgcccacaggaggaggcgggccgccccgagcctgccgtgatcgcctatgactccggcatgtccgttcgccccgctgtgctctgccgcgttagccacgcctcgccggcctcccgccgtgttgaccgcaaccctgacttcgcctggctgccgcgctccattacccgcacgacgatatcccccacgggatgcgttggatggccctcacgggcacagcgaagatcgacaagggcttccgggctctccaggtgcgggcaccgggcttcgtggcgaagctgaggtggacacgtattccgtggagaggacggctcatgtccatgttcgagaagctcaaagacctcatcaagggacaccccgaccaggcccgccaaggcgtcgagaaggccggagacgccttcgacgcgaagaccggcaacaagtaccagagccaggtcgacacggcacagcagaagctgaacgagcagatcggcaaggagccgcccgcgtccgggcagggccgtccgccgcagccctgaaacggggctcaggaccggcagcgcagcaggggccgcccgggtgggtgcggcccctgctgcgggctgatgtaggaaactgcacgcatgtcgtgaaggccgggcgtacggcccggcctgtgtcatgagaggtgtcctgtgcctagtgttgtaaagatcaacgcactgacggtgcccgccgagcagcgggagatcctggagaagcgcttcgcctcccgggccggggccgtggagagctcggacgggttcgagtggttcgagctgctgcgcccggtggagggcacggaccagtatctggtctacacgcgctggcgttcggagcaggacttccaggcgtggatggaggggccgatgaaggccgctcaccagggcgggggcgcgggcgagggcggcggcgagcggccgaagccggcggcctccggctcgacggtgtggtcgttcgaggtcgtgcagcaggcgggcccgaagcaggcctgacgcgatggatcagggcccgggtcgcgcgggccgggctctgatcggcgcccgtggcgcgccacgggcgccgaagatggggatgcggaggggatacggaggcgatacgggaggggtcagctccagaaggcgtcttcctcgtcgatgtccgcggtgcactggtcgatatcggtgatcttgccgccgatgatcgtgaagaagagcccctgacggatctcgataccgcggtctccgcggtcggcgcgcgccgtgtggaaggccatcacgtgcccccgcccgtccgccagcaccgattccagttccacctggaaggtgcccttcgtctcctcgccgaggcggcggaggaggtcgaggacgttctcccgccccttgtggtgtccggacagcgggttgctgccgggcacgtggtggatgacatcggccgtgaacagcgtgctcatcgtctccatgtcgcctttgccgaaggcctcgtagccgcggcggaccagggcacagtcgggatgctctgacatggcgttcccaccctccgggtacgcagggaatgtctttttcctatcatcggcccggccttgtggatattccacgcgggacatccggcgtgaactccacaatgacgccatgaccactcacagcgaactccgcacccccgcacccgcaccgacccccactcccacacccacacccacacccgccctgtcgtggaccgtggcccccgaacccttcaccaccgcggccgccaccgccctgcgccgcgcctactacgccgaggtcgccggccggtactgggaacggcaggtcaccgaggccgagatcgaccagggcctgctcgacttcccggacgacgggctggtcccgccgacggggcagttcgtcgtcggcagactggacggcgagcccctggcgtgcggcgggatccggctgctcgacccccgcaccgccgagctcaccagggtctacgtcgaccggcgcgcccgcggcaccggcggcggggcggctctgctgaaggtcctggaggcggaggcccgtgcgctcggcgccgagcgggtcaggctggacacccggtcggatctcgtggaggcccgggcgttgtacgcgcgtcaggggtatgcggaaataccggcctacaactccggcccctacgcacagcactggttcgagaagcgcctggtctgagcccgaggcggcctagtgggcggcgtggtcccgacgcgacaaggcgtcgtagggctcctcggcgtcggaaccgcacagctccgtgttgatctgcttcaccagcttcaccaggtcggtgggacggtccgggccccaccagtcgccgagcagctcggcgagggaatcctgccgggcctccgcgagcttcgcggcgctcacgcgcccctcgtcggtcagcaccagcggcagcccgtcccggacggcgagcccacgctcctcgatctgccgggcggcgtccgtgacgaccttcagcggcacattggtgcgctcggctagcaccgagggctccacggagccgtacctcttgatccgcagcagcagccagctggaagcgggcagcaggtcgtaccccgccttctcggtgatcttctcgtagacgtgacggcggccctcacgggtgccgaggaccgtcagggcgcgggcgacctcgtcgtgggaggagcgctggacggggttggaggccagggtctccgtcacatcgggggcggtgaccgagacgcggagcttgtcctccttcaggaaccaggcgatcacgaaggcgatcaggacgatcggcaccgcgtagaggaacacatcggtgatggcggtggcgtaggcgtcgagcacccgcggctgcagctcggcgggaagtgcggcgatggcccgcgggtcggcctccagctgcgcgacgctcgcaccggcgggcagcgtgactcccgcgagggaggcggccagcttgtcgtcgagctgatgggtgaagaccgtgccgaagacggcgacgccgaaggaggcgccgatggaacggaagaaggtggcaccggaggtcgccacgccgaggtcggcatagctcaccgcgttctgcaccaccaggacgagcacctgcatgaccaggcccagaccggcgccgaaaacgaagaagtagacgctcatctcccaggtggagctggtgcggtgcagctggtgcaggaggagcaggccgatcgctgtcaccgccgtgccggcgatcgggaagaccttccagcggccggtacggctgacgatctggccggaggcggtggaggtgagcagcatgccgatcaccatcggcagcatgtggacgccggacatggtcggcgagacgccctgaactatctgcaggaaggtcggcaggtacaccatcgccccgaacatcgcgaagccgaccacgaagctgatcgccgagcagagggcgaaggtacggatgcggaacaggcccagaggcaggacgggttcggccgccttgcgctccacgacgaggaaggcggcgagcaggacggcgccgaggacggcgacgccgatgatccgggccgagccccagccccaggtaccgccgagggaggcgacgagcacgagacaggtggcgacgcaggcgatgaggaaggtgccgaggtagtcgatggtgtgcttcgaggagcgcgccgggatgcgcaggacggcggcgatgacgacgagcgcgacgaggccgatggggatgttgatgtagaagacccagcgccacgacaggttgtcgacgaacaggccgcccagcagcgggcccagcacgctggtcgcgccgaagacggcaccgaagaggccctggtacttgccacgctcgcgcggcgggacgatgtcgccgacgatcgccatcgacagcacgatcagtcctccgccgcccagtccctgcagggcgcggaagccgatgagctggggcatgtcctgggcgatcccgcacagcgccgacccgatgaggaagaggacgatggcgtactggaagagcttcttgcgtccgtactggtcgccgagcttgccccacaggggggtggcggccgtggaggcgagcatgtaggcggtgacgacccaggacaggtgcgccatgccgccgaggtcgctgacgatggtcggcagggcggtggagacgatggtctggtcgagtgcggcgatcagcagacccaggagcagggctccgatggagacgagcacatcgcgggaggcgtgctcggcggccgggccggtcctgtccgggtcgggaacggggcccgggccctgcgcggtcacatcctgagccatcgatacctcctcaggccggatcaacatctccatcctgagcggtgtgtccggttatggcctctcgggcggttgggagggctcctgcgggtctgcataatcgcaggcaatagcgagggagggagtccagtgagccgtcagcactgtccagaatgcggcgccgccggcgtcggctgcgggtgcgtgccgggtgtgggtttcaaccccttgcgcatccgcccgtacgtgaccctgcccgaccccggcgagccggacgccccggtgtccccgcagccggtctccggcgcggtggccccggacccgcgccccgcgcccgtaccggtgccggcgcaggacgacaccccggcgtacggcatacccgtgcagccgcaggacggaccatggcccgccgggcctgccgggcccgcgtacgcgccgaacccggccgagacggtccagctccgtgcggtcccggcggcgggccacacgtacaacggcgaaacgggagggggtgggggcgggggcgggggcccggagaagcgaaccggcccgtcctcccgaaagccactcgcgctgctgatcggcgccgcggcggcggtcgccctcagcgggacggccgtggcagtgtgggcgctgccgagtgccgccgagaacgacgccgtgctgatggacgcgaaggcgtcggcgcccgtgacgagcgccgccccggccgcgccttccgcgagcccgtccccgagcaagggcagcccgtcccactcggcctccccgtcgccgagcgcctcgaagtcggcgtccccgtctccttcgccgagcgcgtcccgcacctcggcgcccccgtcgcccagcccctccccgagcgcgatccgctcctccagcccgccgcccacgccgcaggccccgacgctgcggcacggggacacgggttcggaggtggagaagctccagcgtctgctggcggcacagggcctctaccggggcaggatcaacggccggttcgacgggcgcgtggaggacgccgtgtcggagttccagtacgacagagggatcgacgatcaggagtggggcttctacgggccggtgacccgcaaggctctggagggataagcgtcacatgtccgctggtggcgcggaccgccctttgttttgtatcgtgaaggaacaaagtggttccgtcctcattccctgaccggtggacggaaccacttgttctttttcccgccccgtctggagccccgccgatgccggccagcaccaccaccgcacccgtcgccctcaccgccaaggccctgctcctggacatggacggcacgatcgtcaactccgacgcggtggtcgaacgctgctggcgcgactgggcggtctcccacgggctggacccacaggaagcgatgaaggtggtgcacggccgccagggctacgccaccatggccgtcctcctgccggaccggcccatggaggtcaaccacgccgagaacgcggtgatgctggcccgtgaaacggcggacaccgatggcgtgatcccggtcgcgggcgccccggagttcatggccgcgctcgacggtctgccccacgccctcgtcacctccgccgacaccgccctggccacggcccggatgaccgccgccgccctgccgatgcccgagatacgggtcacggccgagtccgtccaggccagcaagcccgaccccgagggcttcctcatgggcgccgccgcactgggtgtggacccggccgactgcatcgtcttcgaggactcggccgcgggcatcaccgcgggccgggcggcgggcatgcgcgtcatcggcgtgggcccccgagctgccgcccacgccccgacggcccacgtcccggacctgacggcactgcacgtcaccaccaccccggacggctcgatcaccatcacactccagccggcggcctgacgccgcccccacgggggtacgcagccaggccgggcggagccatgcccctgggacggcggctccggtacgcgggcgccgcccgggcaggctacgaggccgggcggcggcacgggacggcggcagccgaccgggcggaacgcagcgccagggcggcggctccgggcagcggaacccgactgcccgaagccggcaggtgcagcggcggcttcgcatgcggggccccgtcgggcagagtcggactcctgggcggcggctccgacctacggaagcctgctgacccggttccgagtcccggagcgggctccgaagagcggtagccgctcagtcggtggccagagtggcgtatgggggtttcccgtcagtctcatcgtctctccgtgtcgggccggtccctcaagggcgctccttcgtcgcgtcgcttcgcgatggcctgacggccacccttgaccgaccgtcccgccccggaaatccgaagactgccgagaagccccccaaaagaacgagccgggcactcaaggatcaggacggggcggccagagaccccctgcccggtcccgggtgggcacgcccgacagacggggcccatccagaccccgacccggaccgggggaagcgcgaccaatcgctacgcgctccccacatctcagcgtccgacgaccgtcctggactggacatagaccgcccacgaccccgatcccacgctcaacctgcggccgtcgaccgtcctgggctgggcgtacgccgcccacgacctccatccgatactcgacctgcgcccgacgaccgtctacggccgggtagaagccgcccaccacccacgcacttctccttgccgcgaccggcgatcatctgcggccggcaatggccgcccacaccccctggtcgctccccgctgtggcgaccgacggccggtccgcgcgcccaggcgcatcggatgtcctcatcgacggcgtctgacgcctgcacggggtgaaagggcttgggactgcggctatttcgtcgtggattggggtcagcgcatgtgggaagcccagagggcaggcagtttgccctgattgccctcatttggtgatgggtttgtggtgtcacactcgcgctgacccggttccacgaccgaataccggagctctcagccgtcagcccctctcagcggctctcaccagccccaaaccggccgccgggcgcagtctcgaagaaccccgtggatggtgggcggcttataagcagccccggccggtcgtcggacacaggtcgagggtagatgcgaggtcgtgggcggcctatgtccagcccaggacggtcgtcggacgctgagagatggggagcgcgtagcgaattggtgcgcttccccgacacgggcggcggctgtcatgggccccgcctgtcggtcgtccccacccccgtccgggcagggcatctccgaccaccccgtcccttagagcctggaccggctcgttcttttgggggcttctcggcagtcttcggatttccggggcgggacggtcggtcaagggtggccgtcaggccatcgcgaagcgacgcgaggaacgagcgcccttgagggaccggcacgacacggagagacgatgagactgacgggaaacccccatacacatcactgaccaccgccccagcagctcccgccctccgcagccgccgcccagagttcccgctccggtcggggtggcttccccctcccgaagcctccacccccagtcccggacccgcccgcccgactcccgcacaccggagccaccgccccgccgccccgccccgcgcggagccgccggctactgccccactcggccgtcgatgcattcccgcaggaagtccgcgtggccgttgtggcgggcgtattcctcgatcatgtggaccaggacctcgcggagttccatcggctcgtcgccgtgtccgctgtcccccgtgacgtccaggtcgggggcttccgcgaccagttgttccgcgaaggcgacctcggcgcgccaggtggcccacgcgtccgcgacgacctgggggtcgggcactgcgccggtgaactctcccgcgggatcctcctccgagcggtagtgccggcgtatccgctggcccgccatgacctgtcggaaccagtactgctcgacgcccgcgaggtggcgtacgaggcccagcagggacaggttggagggttccaccgagcgccgtgccagggcttccgcgtcgaggcccgcgcacttgagctccagcgtcaggcgctggtcgcggaggtagccggcgagtacggcacgctcgccctggaaaccgccgtcggtccgggtgtcctcgtcggggtggacgaacatgttggaccagccgaactgccggtcctcggcggacacggccgacgacgcggcctcgcccgcagccgcacccgcagacacgcgcaccggcaccggccccggcatgggcaccggctcggtgaaagggctgatggaggggcggacggatgggcggacgaaggggccggtggaggcagcgatgtcggtcacgcgcatgagcctgacctgtacgttcgcctcccgcaaggaaatatccgccgcctccgcggcccgcgcctccggcgcgtcagcccgcgatcgcctcgtacagcgagaacgcggccagtgcggccatcacggccgccgcgatcttggttatcagccgcagcggcacgtacttcatcagggtgcgaccacccaggatgccgatgcccgcgacggcccacagcgcgagcacggcgccgatgccgacggagacggggtcgtcgtaccgggcggcgaggttggcggtcatgatctgggtcaggtcaccgaactccgccaccaggatgagcatgaagcccgccccggagaccttccagaaagactggtcggcgggcggcttgacctcctcgtcgccgtcgtccttcttcaggagcagcatggccgctcccaggaggaagaggatgccgactacggcctggacgagccggtgcgggagcagcgtgaggacgctgcctgcggcgatggcgagtgcgacgtgtacggcaaaggcggcggcgacgcctgcgaagacgtaggaggcgcggtagcgcgtgccgagcatcaggccggcgagggccgtcttgtcggggagttcggcaaggaagacgacgccgaaggcgatcgccgtgatgctgaagctgaacacgggggtgaaacctcgatcggtcgggcaggacgccatcgggaccgagagacctgggctgtgtcagggatcgcttcggctcggcggcgccctggcttgcgcgtgcgcgtgcgaaacgcgcctgcgcggaacaggacactgcggccgaaggtctcgctggccgaccgctgtcagcggcctgcctccgggcgccggctggggtgacccagcagtatgtcgacggtccggcgaagagctactccccttctgctccgatcagagtacgcgacgcccccggtgggccggaatgggtctttggtcccgcctcgggtcgccccgcgtcgcctccggcggcgccttcatgccctcccgcggtcgcggaatgtcaacttccgattaaatccgggacgttgagcgacttgatgtgacgtgctcatgtcgccaggctgtcacctggcgcccatccccgcgatacccggcgccgccacgatggccacgccccgccggggctgcacggccacaccccccgcacccagggagcccctcatggcactcatacccagcatctacgcgcgtcgaattggcgtgctcgcgtcagcagctgcactcgccgcactgacctccctgctcaacgctcccgccgcccaggccgccccgcccacccccatcagcgcctcggccgcccgcgcctacctggcgacggtcaccccgaagaccgaggggtccaccagcggctacagccgcgacctcttcccgcactggagcaccgtctccggcagctgcaacacccgcgagaccgtcctcaagcgggacggcgtcaatgtcgtccaggactccgcctgcgccgcggtgagcggcagctggtactccgagtacgacggcgccacctggaccgccgcctccgacctcgacatcgaccacgtcgttccgctcgccgaggcctggcgttccggtgccaactcctggaccacgagcaagcgccagcagttcgccaacgacctcacccgcccgcagctcatcgcggtcaccgacaacgtcaaccaggccaagggggacctcgaccccggcaagtggctgccctcgcggacggcctaccgttgcacgtacgcacggatgtgggtcaacgtgaagcagtactacgccctgagcatggactccggcgagaagacggccctggtcaacatcctgaacggctgctgaccaggccggccgatctttcccccgtcagggggaggcgtggctccccccacccgtcgtaccgtgatcgaaggggctacggaggagggggagttgcatggccggactgcgtctggggccgctgctgcgccacgtcgactgggacacgggccggtcggccacgatatgggtcgaggcggaccgcccgtgcgcggccgaggtgcggtgcgcggacggggcgggcggcagtgcgcgcaccttccagatagccggtcaccactacgcgctcgtgccggtgaccggcctgacccctggtgcgaccacggcgtatgaggtgctgctcgacggccggccggtgtggccgctgccggagagcggtttcccgccgagcacgatcagcgctccggccgtggcgggccccggccggtccggtcccgggctgcgcgtgaccttcggttcctgccggcaggccgcgccgcccgccggccggcgcgggccccatggcgcggacgcgctcgacacgctcgcggcgcggctggccgcggacccggatgcggtgcgccccgacctcctgctgctgctcggcgaccaggtgtacgcggacgcgctgtcgcgggagacccggcagtggctcgcggcccggcgggaccttcgggagccgccgggtgcccaggtcgcggactacgaggagtacacccggctctactacgagtcctggctcgaccctgagatccgctggctgctgtcgaccgtccccagcctgcacatattcgacgaccacgacgtcatcgacgactggaacacgagcgcggcgtggctggcggagatgcgggcgacgccgtggtggcgggagcgtgtcctcagcgggctgatgtcgtactgggtgtaccagcacctgggcaacctctcccccgccgagctggcggccgacgcggtctacgaggcggtacggcagaccccggacggtacggacgtgctgcaggccttcgcgtccgcggcggatgccgatccgggcacggtgcgctggagctaccggcgcgacttcggccggacccggctgctgatggtggacacccgggccgcgcgggtgctggccgaggacgggcgggcgatgctcgatccggcggagcagcagtggctgcgggagaacgccctggccgggcacggtggttacgaccacctgctgatcgggtcctcgctgccctggctgatgccgccgctgatccacgacgccgagacgtggaacgccgcgctgtgccgcggggagcgggggccgcgctgggcgcggatcggggagaacttgcgccggcgcagcgatctggagcactgggcggcgttcccggcctcgttcgcggcgctgacggatctgatcgaggaggtcgggacggggccgcgggcgccggcgacggtgtgcgtgctgtccggggacgtgcatcacgcgtatgtggcggagcctcgaataccgagtaccgcgcgggtgttccagctgacgtgctcgccggttcacaattccatccataccgcggtgaagtggggcttccggctgggctggtcccggacggggcggtggctggggcgcggcttctccctgcacgggcggacggggcggcccccgctgaactggcggcgtacgggtgggccctggttcgggaaccagctgatgacgctggccctgtcggggcggacggctcggctgcggctggaccaggcgcgcaagaagcgcgcgggggccgtgctggtgacggtgctggaccgggatctcacggcggcggagtagcgggagcgccggccccggcggtacgggggggctgaactcggcgtcccggcggtgccgggggggcggaggaccctgggcaggcgtcttcgccggacgtgtccgtcggacgtccctgccggacgtccctgccgggcgggccgggcgcgccgggcgggcgccccggggatccagggtgtgaacgccgggcgtacgctgtctggctgtcaagccgctcctgccgctccccgcgacgtcgcggcgcatcgtgccgccgcacgtcaaccggactggggagtcccgttttgtttgagacgctgggatcgctgaccgcgagcccatggatctacgccctcgtggcggtgtccatcgtgctcgacgtcttcctcccggtgctcccgagcggggtgcttgtgatcactgcggcggcggccgcggcggccgccggcgcggcgggccccgtgccggtgccggtacccgagcaggtgccggacatcctgctcctgctcgtgatcgccacgaccgcctcggtgctgggcgacatggccgcgttcaggctggcccggcgcggcggtgcccggttggaccgggcgatcgcccgctcccgccggctgacccgggcccatgagcgcctcggcacggctctggcgcgcggcggcggcgccctggtggtcatcgcccgcttcgccccggccggacgctcggtggtgtccctgggcgcgggcaagacccagcgcaaggtggcggagttcctgccctggtccgtcctggcgggcatggcctgggccggttacagcgtggctctcggctacttcggtacgcagtggctgggcacccagtggctgggcaccgcgctgtcggtggtcgccctcttcgccgcgggcgcactggcggcgttcctcgtccgccgcccgccgccggccgcggcgtaggcggctccgctttccccggcgctcccccgggtggagcagtggctcacccgttcacccggccccgatcgccgctcccgggctgggctcctagcgtccacagcacggtgcgcaaccgaatgcgcctcacatccgtggcccggccgcgccgtttcgacgagccgaggagtcctctccatgcccgccaaaccgcccgccgcaccgcgcgcggcagcacgccgcctggtgaccgtcgcggccgcgaccctcatcgccgctgccgccgctcccgccaccctcgcgtacgccttcccctccgccaccgtctcccccaccgccgtcgccccgggcggccgggtcgcgctcaatgtcacgggctgcgggacgcaggtcgccagagtcacctcgaccgccttcggcgaggcccggctgaccccgggcaaccagaccgccgccagcctgatcggcagcgccaccgtcttcaacaacgccagctcgggtgcgcaccgtgtcgtcttcgagtgcggtggccccggcggcgagcgcgtcaccttgtccctgcaggtcagcttgggtgcggcgcggggtggtacgggtggcagcatcggttcgatgagccccgggcagatcgccgtcggcggcgccctcaccgcgggcgcgctgggcgccggagtgtgggtgatgcgccgccgcgcggcggcctcgtaggcctggtcggcctggtcggcgtggtccgggtcaggccggggcggcctggccccgtacgtgtaccccgtcgagcagggccgcggtggcctcggcgacggcgtccaccgccgcttcgaacacctcgcggttgtgcgcggcgggcgcccggaacccggacaccttccgtacgtactggagggcggcggcgcggatctcctcctcggtcgccttctcggggatcgcgggcgggcgcagggtcttaatggagcggcacatacccctactatcccgctaccggggcagctcggccccggaaagtttcatgatcaaaccggcttggaggcgggccctcaaccccgcgtcctcgaccgtgtcgagcagttcgatggcctgctgggtcgtctcggcggcccgccggtcgtcgcgcagcgaggcggtctggtcggccatgtgccggagcgcgatgtcggcccgccggtggaagagctgcccgatcagggtggtgaccagccccgccgcgctcgtgacgatccccaggtacagctccccgtcggcctcggccttccagacggccagtgcgaccccgaccagcaggatcgccgccccgacgccggcgaaccgctggctggtcacaaagctgctccgtgcctgggtcagtccgtaggcgtagtactcgacgaggatcggggtgaagtcgtcccgccggtcgccgagccgcgccgcggggtgcgggatcccgccgacgtcctggaacttccccccgccgggcacgacggacggcccgtcggcgtcgcccggctcggcgaggtgcgcgagcagccgcgcccgctcctcgtcccgcttccgctcgaaccccacccccagggaccgctccatcagcgccagcgccacggcgaccacgccgacgaccaacccaccccacgcgagctcgcccatcccccgacgatcccacgccggccaccaccggccaagggagcgtccgcctccaaatgcgaaggaaccgcaccgaacctagactgaccgaggcatggagagtcgccgacaagggagaccagcatggctaagcgaggcaacaagcgccgggcccgcaagaagaagaaggccaaccacggcaagcgccccaacgcctgacccgaaagacccccgacctcacggccgggggtcttcgctgttgggacggaagcacgccgggcacgcgcccgggtcaacgccgcctggtcagatcaacggtggtgcccccgctgaagagcgaatcgtgcagctcgatgcggacggggtcggcgttcttcggaacgtcgaagacgacgatgccgtcgacggcgttgcccgggttgatctgctggaggaaggaatcgcttccgtcgagatggatggccgcggcggtgtccgcgctgtacttgctgccgttgcggtcgatgagcttctggtcggcgccgtcgaaggtgcgcgcccggtccccgatgttcttcacggtcatgtgcacgaggtagaactgcccttgcgcatcctgaccgtacgcacccccgatatggcccacgccgggctggagccgggtgacggtgaactcgaacttcccgtcccgggccggctcccccaccccgggcagacgcccggagtccgtgacggccttggccttggccttggtcgcaggcggcggcgcggtcgaatcctgaccgccgagtgaccccaggacccccaggatcacgagcccggtggtgacggccagcagcaccgtcaacagccgatgccgggcgaaccacccgcgccgatcctgcggacgctcgggggcaggcccccactgcggtggcggctgagggctcatggcgacctccgggctaggttctgtctctttggtcagcgtcgggtccagatgaggatgccggcgaggtggagtgcggcctggtaggcgatggcgagcttgtcggttcgtatggccaggccgcgccactgcttgagccggttgatgcagcgttcgaccgtgttccgctgcttgtagacctctcggtcaaagccaggcgggcggccgcctcggtggcctcgccgcaggcggtggccgatctggtcggacggctgcgggatgaccgcgcggatgccccggcgtcgcaggtggctgcggatggctcgggaggagtaggcccggtcggccagaacgacgaaggggcgggtccgcggcctgcccgtgcctctgcggggcacccggatgcgggccatcaccgtctcgaaggcgggtgcgtcaccggcctggcctgcggtgacggtgaatgccagcggccgtgccccaccgtccgcggccaggtgaaccttggtgctcagcccgccgcgtgagcgtccgagcgcgtgatcggagggctcgccggagcgggccgcccccttttgcgtgcgccggccgcgtgctggtgggcccggacgaccgtggagtccactgacacggtccagtcgatgtcgtcgtcggcgtccgccgctgccaggacggaggcgagaattttctcccaagtgccgtcgacggcccatctgagcagtcgtttgtgagcggtctggaacgacccgagctcgtcgggcaggtcccgccagggcgagctcgtgcggtacttccaagcgatggcctcaagggtgcggcggtggtcggcccaccgccggccgcggaccggatcggccggcatcagcggctcgatccggccccacatcgcatcagtgatcactaatcggacagacacatccgatcaactgaccaacccatcaaagagacacgctctaggcctcgcggatcccgattgtcccgccccacgcgctctccggcattccgaggacggaaggagcggcaggcccccgccgccccgtcagggcccgcccgtcacgcgtccgagcgcagctcgtccagctcatccccgatcgcctcgcgcagccggtcgtgctgcggcccgagcgcgtactgtgcgtcgctccatctggcgcggggatagagccacaccggcaggcgcaccaggtcggacggctcccactcgaaccgcggccacacgtgcgcgtgcaggaagccgtcggtgttgcccaggatctccaagttgacccgtcggaagactccgtcgaaccggcggcaggccctctcgacggcttctcccaggtggtccatgtcggacaggaacgcgagccgcctgtccctggacaggtccgacagcctctcgacggtcggatcgtcggccaagagcaccgagtagcccggcaggaactgcacatcgccgatcgcagcgaacccggcgcccaagcgccgcagcaccgtggggttttcaccccgcagcgcggttccgatccggtccttgcgccaatcgcccgtcatcatgtccacaacgtacccagctgtggatccggatgccgaaggaccccccgccatgatgcggcggggggccgttcaccggtgtcagggcttgttcaggtccttccgcacatggctgtagaggctttgcgcggccgggttgacgacatgctcaccgagctttttccccgcctcgaaggcgtgctgctgagccgagccgtcggtggggtgcttcttggcgtgctggtaggcggcggccgcgttcgcggctgccagggtcgcccggccctgaggtgtcttctgtgtccaggtgtaagcgctgtgcgcgatcttcacgagcgcgccggcaacggcaagtaggggaatcggcatggtccctccctttcctcgagaaggtcatgccacgtcgccccatgtcccaaccccccaggggatgacccgaattgtccctaggggacaggaggatcgagagcgtgttcgcgatagtgggccgcctcgccacggggcatgcgggtctacgtcgtgcggctggtggcgcccgggaagacgattcagcgtccttatccggtatcgcaatgtcacgccggtcgaggccaaacggctggccacggtggcggtcgaccacgaccgtcaccgtaacggccgccaggccagacaccgcccgtcagttcaccaaggggaagccggcgaagccgtcctcggtctggtagacgaggtgcacgttctgcgatgccagcagatccttaacgtccttgctcggctcgctgggcagcagcacagccgcccgcaggccctgagggttggggacgtgccggcggtagtcggcaagctgaccgatcgccaggcggatgttgttgcgggtggtcagccccttggcctcgtacagcacgtgatcggtgacgtcgtacaggtcaggggtgagggcgcccacctcaccagcgatggtgatctgaaacgacttgtgcacgtggccggcagcctcaaggtccttcttgaacgcctccatcaacaagccctcacgacgcagaacggtacgaggccctccaggaacatcagcaaccgtctccgaggtcgtgtgctgctcggacttcttgtccttcacgctggtctgcgcgggaatcaccggaacggtgtccacgtcctccacgtcattgccggccgccggcttgagccagtcctcttccttccacgccggagccgaccccggaaccggccgaagccgaaacaccagagcgttacgcatcttgtggtcctggcccggtccgcggcgaatctcaacggggttgatcgggtccacggtcatctgcccgatgtaccgctggcgcatggcgccgctaccacccggcaccttgccctgcgcaacgaacaggtgcagctcacggccgtcctcgacgtggtaccgcagcgacttgttgcggctcttcatctcctggtcaccgttcgcgccgtagccggtgtacaagtacagcgggccgtactcgtcatcctcagcgcggccatcgaaggtgtagccgaactcctcgcccgcagaagggtcagagtagacgaacaccttcttcgcctcattggccggctcgatgccctggtacttcccaccgccgaacgcagccacgacctcatcacgcgtcgtgatcaccccggggacaagctcaaacgtcgtcgtcatggtcacgaccataagcagccccaccggcatcccggcactgcatttctcaacgaaaaatgccgccttaccgccagcgcatccacgagaaggaaggccacgccctgcgcgagcggctcgccgcttgggctgactccgtacgcgagcgactcatcgacgcctggcccgtgctgcccgaaggcgtcgtggaccagcttgcaggcgtctgagagcccagccactcctcggttcgcagaagcgggccggccgtatgtatggcccgagcgggcccgcgccgctcgcctggaactcgtcaacgccgcacgcgatgacgatgagccttacgtcaggagctggtcctccgcgaccggccaagctgtctgagtggctgccgttctggctggagacgctcggcgtgccagacgtgcggcggatggtggctgccgtgaccgcgcaggcctccgccgcgactgcgaaggagtcgcaccgcacgctgcgcaacgtgctcactgcggcgaaccgtgaggagctgatcagccgcaacgtggtgatgctcgtgccagcgccgcgggtcgtacagcgtgagttgaagccgtgggacctcgacgagacgctcacctccctggcggccagccggcgcgaccgctgtacgcggactccaccaggatccgccggacccgagtcatcccggtccggctgccccgtcgggccgaggaacaccagccagtcgttcgagcggatcgcggacgggtcgccaccctgctgttcccggccggggtggagatcttggggcactcgcggatcgccgtctccatgaacatctacacccacgtggctgaaggcggcaggcgggaggccatggggcacatggaccggatgctgcgtcgtcggcggccgaccgagtaggcggcttccgtcacttggaaccgtcaaaggcccccaaccatgatcggttgggggcctttgtgctggtgggcgcggacggtttcgaaccgccgacatctgctttgtaagagcagcgctctacccctgagctacgcacccgtggatgagtggacagcctacatggcgtgcgcaccccccacgcaaacccgttcccgtgggagagaatggaccggggcatggcggacgcggtacgggagaggcattgtgacgacggcatcccggcggtggttcggcgggcgggacgagagtcggcgggcggatgcgcaggcggcgaaggatgccgccgcggcggcgttctacgagctggacacggcgcagcgggatctgcggatctcgatcgagacgatcgccgcggcggacgggtcgcccgccgcgcggcaggcgaccgaggggttcgccgcgctggggcggcggatcgacgaggtcagtcacgtctacatcgaggcggtcgacgcgcacgacctggaccgggcggagttggaggcctcggtcgccacgcgcgcgcgggagcagctgacccgggcgcgggaggagctggtacgggtccagggggagctggagcggttcgcgacggggctgcagccgctgctggacaaggccgagacgcagctggcccgggtggcgccggcccgggagcgggcgagggccgcgctgctcggggcgagtgacgcgctggacgccgtacgggccaaggggatacgggccgatgacctcgcggcgcggctggcggcgctcggcccggagctgacgaagctgaaccagggtgcggcccagcacggcgtgcaggagacggtgcagcgcgccgaccggatcctgcgtgacgcggaggccgtacgggccgaggcggcccggctgcccgagcgggcggcggagatcgaccggcggctggtgagtctgcggacgcgcgcgcaggcgttgcgcaaccgggcggaccgggtggatccggtgctcagtgagctgcggcggcgcttcagtgcggcctgttggcaggatctgcagcacgtgccggacgaggcggtacgggacgtggcgcgggccgaggagcagctgcgggaggcgggccgggcccgggacgagcagcgctgggccgaggtgggggcgctgatcgaggcggtccgcggctcgctggacgcgacggacgaggcggtgtcggcggcgcaggaccggctgacgcggctggaggcggtggcgcgggatccgcaggcggaggtggaccggacgcgtttcgcgatccgggacgcgcagcggctggcgatggcggggcgcagtgtgccggatccgcagcacgcgcggccgctggacgacgcggtggcgcgggtggcccgggcgctttcggcgctggaggggcggcatccggactactgggcgttcctgctggagatggcggacgtacgggcttcggtgaaccgggtggtgagcgggatccgggccgagcgcgggcacggctgaccggggcgtcgccggcacccggttgtttccgggcgtccggcggcggatgctgggaggtgccgggaacggaccagaggagggcaccatggctgcccacacccgcaacaagtcgcccgtgacccatgagccctatgtggctcatgcggcgtacgggtgcacggaaccgcatgagcactacgcgccctacgtcgcgcacgagcccgatcccgacgcgccctctcctccgcgcctcgccgacacggtctcccggcgcgtggagcgcgcgctgcatcccgtcaacgcgcagctcgacgatcatctgccgaccgaccacaagctcggccaggtgtaccgggtcggggcggggctgacgggcgtgctgctggtcgtcttcgggatcctgggtctggtgaaccggatcgggttcttcgacaccggcggggacacggtgctggccctgaacacgaacggggcgctgagcgtcctgtcgatctgtttcggcgcgctgctgatctgcggaatggtggtgggcggcaccttcgcctcgaccctgaacatcgtgctgggtgtgctcttcatcgcgagcgggttcgtgaatctcgcgctgctggacacggagctgaacttcctggccttcaggatccagaacgtgttgttcagtttcgtcgtcggcgtgatgctgatgtggttcgggatgtacgggcgggtgggcagtgccctgccgcacgacaatccgtactggcgggcccgccaccccgagcaggcggcgcgggaggaccgggcgcgccgggccgggtcgggccggacgagagtcgcgtagcgcgcggtgcccgggcccgcttagcctgtgcgcatgcctcgatacgattaccgctgccggacctgcgacgacacctttgaggtcagccggcccatggccgagtcctccgcgcccgccgactgcccggcggggcactccgacaccgtgaagctgctgtccgccgtcgcggtgggcgggacgagcagtgcccccgcgccggcgatgggcggcgggggcggctgctgcggtggtggcggctgcggctgatgtcggggcggccgccccgaagctagcgcttgcgcgagagggtcaggccgtccgagatcgcgagcaggacggattccatgcgcgggtccgccgccacgtggtcgttgaaggcgcggacgccggccgccgcgcccgtggccgattcgtcgaggaccgtgccgtggtacagcgtgttgtcggtgacgatcaggccgcccggacgcagccgcggcacgagctcctcccagtaggagatctggctctgcttgtccgcgtccacgtaggccatgtcgatgtgcggttcggccggcatcgcgcgcagggtctccagtgccggtgcgatgcgcagctcgatgcggtccgcgacgcccgcctcctcccaggcctgcctgccgtaccgcgtccactcctcggagacgtcgcaggcgatgaggcggccgtcggcgggcagcgcctgggccatcgacagggcggagaagccggtgaaggtgccgacctccacgatgtggcgggcgcccgtcagccgtaccaggaaggccagcagcggcccctgctcctccgccgactgcattccggccacgtccgggaacttggtgtaggtcgtcgccacgagcccccgctggacccggtccagcggggggttgtggtcgagcatgtaccggtagagctcatccgtgattttggtgctgttgcccttggtcatgcgtccagtctgccgagtcgggccgcctcctgggcgaatgcgcgcacgatctcctcgcccgcgaggacgcccgccgtggccagcgcggtcaccgtcggggccgcccaggccgcgtcggccagttcgccgtggcccgggcgccaggcggcgtccgcggccagcagcaggtccgcgtccagcagcgagtcgccggccgcgagggtggtggtggctcccgtacggcgggcgacctcgtgcatcgccgcgctcttggtgagcgggcgcgggaccgcgtagatcttccggccctggagggagaccgtccagccgcggtcctcggcccaccgggtcagggacttgagccattcgtccgggaccaggtcccgttcgacgacgaggtaggcgaagaggtcctcggcgaggcgcgccttgcgcagccacgccgggtcggccgtggacagcaggtgctggtgcacctcctccaggggggcgcactcctcggccaggcgcgcggcgacctgccgccgccagtcgcggtccgggaccccgtcgacgagcagctgcccgccgttggcgcagatcgcgtacggggccgggcggccggggaagcggatgcgctggtactgcttgcgggtccgggtggtggtggggacgaagaccaccgaggggtcggccgtcagctccgccagcagtcccgccgccgtttccgtcatgtaggacagcggcttgctctcgtggacctcgacgcacagcagccgcggggccaccgggtcgggcatggtcaggccgagggcggccgccgagtagatgagcgtacggtcgagatcactggctacgaggacagtcacttcgaggccacagcctttccgtcggcgccggtggcgccgcgcgtgaatcgggggtggatgagtcctacgcacgtgtagggcagcccgtcgacctcttccaccgggacgccgcgctgctcggcgagcagccgtacgtggtccaggtcggccccggcgccgcgctgcgccaggatcttccacggcacccggcgcagcaggacgcgggtggtctcgccgacgccgggcttgacgaggttcacgtcgtggatgccgtactcctcgctgatccgctcgacggccgcccagccctcccaggtgggggtccggtcggccgcgaggagctccttgacctcctcgtcgacggcgtcggccacctcgtcgaagtgggcggcgacggtgtcgacgaacgcgacggagacatcggccccggcgagctcgcggtagaacttcgcgccgtggaagtcggcgggaccgacgaggtcggacctcagaaccgtacgcgagatgagaccggagacggtggaattgagacaggcggacgggatcaggaagtcctcgcgggtgccgtacgtgtccacgcacgagccggggtcggcgaggaccacgatctccgggttgaagccctcgaactcggcgagggcctcgcgcagctcgcgggtgatggcgcccttgccggtccagccgtcgacgaagacgacgtcggccgggtcgtggtgggcggccagccagcgcagggcgttggcgtcgataccgcggccgcgcacgatggagacggcgtagtgcggcaggtccaggccgtggcgggcgcgggcccagcggcgcatcagtacgcctacgggggtgcccgcgcgggccagggagaccaggaccggggacggggagcgctcggcgaggacggtctcggtgaccgtgccgacggcccgggccacgcgggcggcggaggcggccagcgcgctgccgtacagctcctggtactggggggagggctggtactcgacgggcagggattcggcgtagtgcgcgccgcccgcctgtatcgcctcctcgcgctcctccgtcggcgcctccagctcgacgccggagaagtcctggagcagccagccgacgtcctcgggggcgtacgaggagaaggcggggccgcgcaggggctcgcgcagcggctcgcgcagggtcggctcggtgggctcggtcatggtcggcttcggctcccgccggtcgggtgtgtaggacgggacgacggccagtacgacgtggccggtgtgcggggcgagggccgccagcagtcccgtgtgcagctcgggggtgtccccggccgagtccacgacggcgacgacggcgtcgaaaccggcgccgtccgtgctgtggacgttgtaggcgtagcggtcgccggggccgtcggccggggcgtcgtgggccgggaagaccagccgggtgcggatggcgtagccggggtcgtcgacggcgagcacgggcgagcgcgtggtggtggagaagcggacctcgcgggccgcccccgcttcctccagggccttggcgagccgcagcggcgcgtacatcagctcctcgttgccgagtacgaggacccgcccgggcgtcgcgccgagcgcggcggtgagctgggcggtcatcgcgggcagggccgcttccagcgccgtgcggtgggcgggggtgaagccgtgtcggccgccgtcggggaccccggagggccagttcaggtcgacgcgcgtgaccggccgcgggccgtctgccggggctccgcccggcccggctgcggggacgtcctcggccagagcctcgtgttcctcgaccagggcccggcccttggtgaggacgtcgtccgggagggagaccgtgcccgaggcgagggcgatgaggtccacccgggcgcccagctcggcggcgaaggcggtgagccggtcgcggtcggccggggagcgcatgtcgacgagggcgacgaccacgtagtgcgagcggggatggcgggcgtgcaggtcgcggatggtgttcaggaccgtgttgccggtggagaactcgtcgtcgacgaggacgagcgggccgctgcccgcgagcatctccgggtcctcgggcagcagcaggtgcgaggtggcgtgcgagtgcgcctcctcgaagccgccggccgcccgcacgccgggtacgggccgtcgggtggagtgcaggtagggggccgggcccaggccgtcggccacgcagtggccgagcccggtggcggtctcggcgtagccgaggaccacggcagcggcggccccgtcctcgccgagcagggcccggacgcgttcgccgagcccgtacccggcggcgtacacggtccgcggggactgcgggacgtgcttgcccagcacctgcgaaaccagcaggtgcgcccgcttggggttgcggcgcagagccagtccgagcagctccgtcagccgcagaccgccttcggagtcctccaggctgacgcccagccgctccgcgacccaggtacccgaccacactgcttcgatcgtcttgcctttcctcgtcgtcggcgcggccgtcggcggccgcgcgtccctttccgggggcctgctcacacctggagcccggccgtgagcaggtcgacgaagccgacctcctccttcgccacaccgaagacctcggcgcgcagcatggtgcgctcggcccaggcccggtggggcttcacctcgttcatcttgttcgtgtaggcgctgcgcatcactccgccgccgccgcgctcgggccgcaggatgtcctgcgcgtcgcagaactcctcgtgcgagaccaccgacagcgcgtgcacgggcgtgacgtgggcggggtggatgcaggtcttgccgagcagcccgttggcccggtccagctcgatctcgcgcagcagtccgtccaggtcgtgctcgatcagggcggtgcgcagttcctccacgccctcctccaggaaggggctgcggcgcagctggggcttgaagaggcgctgctggctcctgaagtactcccagacgggcccggtcaccgtgaagccggtgccgtcggccctgctgaggacgttgacgacgtccgcgatgacgcccgcgacgatctggacgtcgtaggcggtcatgtcgggcgtgcgccgcaggccgtaggccgagcagaagtcggtcacgccgagccgcagcgccaggacgcgctcgcggtggctgttgaccgtgcgggagatgccggcgagggcctcgacgcgggtttcgaggtggaggaggtccggggtctccaggacgggcatggcgtacaggcggggcagtccgacggccctctccgcctcggcgacggcttcgaggaaggcgatcccgcggttctcgtcgaacttggggagtacgaatccggccaaccgtcgaacggagccgcccagccggcgcacgaggtcgggtatctgctcgggcgtgcggacgcggatgaagagcagcgggagctccgcgccgtcggcgtcgagctccgagaagtgccggacgaggttctcctcggccccggcgacatcgccgtcgctgatggaatcctccaggcagaggaccatcgagacgactccgcggcgggcctgcttgcggatgtcggcggcgagcgtgggccgggtggccgggctgtagagcgtggctcccagtgctgccgcgaggacgcgggagggcgaggctccggtgaattccgccggttcctggtggaagaggtccttacggacggtgggcgttatgtgcccaaagtgacgcatgtgcttcccccgtactgcctcggcggcccaactggcatggccggtaatagtacgtacgaacgtgagtcaagagttcctcaagcacatgaagttcaggtaaccctcttgcaccatgcccaggtctcgcgttcgagacaaggccctacggggggccgcattgtccctgtccaccccgggagggcaggatgacgtgcatgacgcacgcgatgcagaagggctcgaacatcccggtggccgccgtggcggtccgggcggtgctgcgctggaccggcggccccgacgtgccggacgtggacgcctcggcgctgctcgtcggcccggacggccgggtgcgttcggacgaggacttcgtcttctacaaccagccccggcacccctcgggggccgtctggaggctgggcaagaagcagatcggtgacgcgatcaccgacgccgtccaggcggacctgcgcacggtgacgcccacggtggaccggatcctggtggtcgcctccgccgaggacgtcccgttccgccgggtcggcgacctgcggatcctcctctacgacgccaccgcgaccggcggctccgaaccgctggcctacttcgacgtacggcccgagaccggcgccgagacggcgctgatctgcggggagctgtaccggcggggcgaggggtggaagttccgggcgctcggcgagggctactccgacggactggtggggctggcgaccgaccacgggatctcggtcgacgagaacgccgccgagcctgagacgggcgccgcggcgggcgctgccgccggcccgggaaccggacccgcctccgagcagacggcgatgatggccccgcccacgcaggccccgccgcccgtccagcccgcgtacgggtacccgcagccggtgtccccggccccggtgccgggtccgggcggcgatccgtccttccggctgccggtgcagggcccgcagttcatccgccgctgacgccgtcggcgtggacggcgttgccgtcgcggccgggggctccggtcagctcttggtgctcttgtagccccgcccccactggagcccccagccgtacagccggtccagctcggcctggaacccgtagacgaacttcacctcgcgccgcacgacgagctcgcccttgaccttctccagggagacgaccgcgcaggagcgggcctgcgggtgccgctcgtccagcgggatctcgatccgcggccccgtgaccgggtagagggtcaccatcgcgtgcgtccggtcgaaggccggggtctggtcgtagatgtagacgaagaccagcagccgcttgatctcgtcggcgtggtcgaggttgacgtagagggtctcccccgacgccgagccgaaccggtcgtccccgctgagcttgacgtacggcgggtcgttgaggtcgcccagcaggttccccagcggctgcaccgcgccccgggtgccgtccgtcagctcgtacaggcagcccatgtcgaggtcgacgttgaccatgccctgggtgtgggcctgcaccatgtccggcttgaagagcttgaacgggtgccggaagagctgcccgctctgtccggagcggccgccgatgtccgaggtccgcatgcgccaggacagattgacgcgcagattgccgtggacggccccctgtttggtgagcgacaccgtcgaatgtcgcctggtcagctcgatcgcgttcgacgaggcactgcccgactggaactgcacggcccggctgcccatgatgccgtcgaagaagcccatcccctacccccctggtcccctgatcccctgtacgcctgagcctacggaagcggggcggcccgccgggtccgtggacccggtggaccgccccgcaatggagcgttccgcattaccgccgcggtcatgcctcggcggtggaaccctccagttccaggcgcttgttgcggcgcacggaggaccagaaggaccatccgatgagcagcacgccgacgagaccggtgatgatctcgttgatctcgtactggatggtgacgagcaggatgatggcgagcgcgccgatggcgtagtgcgcgccgtgctccaggtagacgtagtcgtcgagggtgccctggcggaccaggtagaccgtcagcgaacggacgtacatggcaccgatgccgaggccgagggccatcagcacgatgtcgttggtgatggcgaaggcgccgatgacgccgtcgaaggagaaggaggcgtcgaggacttcgaggtagaggaacatgaagaaggccgccttgccggccatggcgacggccgtgacgggcttgccgctcttcttggcctcctcctcggcctcgtgctcggcctcctcctcttcctccagcttgttctcgaagtagccggagaggccgccgacgatcatgtaggtgatcaggccgaggacgccggagaccaggacggtctgcgccttgtccacgtggacgccaccgtgctggtgggcgtgggcaccgacggtcatcgaggcgacgaccaggacgatcagcgcgatgcaggcggacagcatgtcgaccttgccgagcttggcgagcgggcgctccagccaggcgagccacttgatgtcacggtcctcgaagatgaagtcgaggaagatcatcaggaggaacatgccaccgaaggcggcgatggacgggtgggcgtccgtcaccagctgctcgtacatctccttgtcggagagggccaggtcgacggcctcgatgggcccgatcttggcgctgatcgcgacgatcacgacggggaagaccagccgcatgccgaagaccgcgatgagtacgccgacggtgaggaagatcttctgccagaaggcattcatcttcttcaggatcccggcgttgaccaccgcattgtcgaaggacagcgagatctccaggaccgacaggatcgccacgataccgaaggcctgccaccccccgtagaacaccgctgcgaccagaccgagcgcagtgattgcgaacgaccagccgaaggttttcagaaccactggcaccccatcgtcttgtacggctttacgaaacgttgaccccgaagtctagagcgatgcctcggaggcccgacgcgtacccctgccccaccgcccggaacttccattcgcccccgtaccggtagacctcgccgaagatcatcgcggtctcgctggacgcatcctcggacaggtcgtagcgggccagttcctgaccgtcggcctggttcaccacacggatgaaggcattgctgacctggccgaagctctgcctgcgggagtccgcgtcgtggatcgagaccgggaagacgatcttgtccacggccgccggcaccttggtgaggtcgatgatgatcgactcgtcgtcgccttcaccctcgccggtgaggttgtcccctgtgtgttcgacggagccgtcggggctcttcaggttgttgtagaagacgaagtactcgtcccccagcacccggccgctgttgcacagtagcgcgctggcgtcgaggtcgaagtcggctcccgtggtcgagcgcgcgtcccatccgagaccgatcagaaccctggtgaggttcggtgcggccttggagagggagacattgccccccttggcgagtgtgacgcccatgttgtggtcctccccggacgacggtgtggcggtatggcggtatggcggtgcgatgcagtgcggtgcagtgcggtgcggtgccgtggtgcaccgtatgcgtgtacggcgatgcggtgaagcgcgtccggcgccgtacacacagtgcacggcgccggacggacggactgctctcgggatcagacgttgacgccgaagtcctgcgcgatgccgcgcaggcccgatgcgtaaccctggccgatggcacggaacttccactccgcaccgttgcggtacagctcgccgaagaccatggcggtctcggtcgaggcgtcctcggagaggtcgtagcgcgcgagctcgctgttgtcggcctggttcaccacgcggatgtacgcgttgcggacctggccgaagctctgctggcggctctcggcctcgtagatcgagacggggaagacgatcttggcaacgtcggcggggacgccggccaggttgaccttgatcgcctcgtcgtcgccctcgccctcaccggtggtgttgtcgccggtgtgctccaccgagccgtcggggctcttcaggttgttgaagaagacgaagttcgcgtcgctggtgaccttgccctggtcgctggtcaggatcgcgctggcgtcgaggtcgaagtcgacaccggtggtggtgcgagcatcccagcccagaccgacgatgaccgccgtcaggttaggcgcggccttggtcagcgagacgttgccgcccttgctgaggctgactcccacgggtcctccattgggttctgtgtgtggggcggtgccccgtcgtgcagggggccctcccggccgtgaccgggggagctaccggatcaacgtttcgatcctagtgacgggttcccgcctgtaagcggttttcgcagggaaaatgcgtgtacgggccgctcgggcgcgctcagagagcgtcgagtgccttgatgtactcgttcaggtcacgcgcgtcgggcagtccgttgacgacagtccagcgcacgacgccgtccttgtcgatgatgaaggtgccgcggaccgcgcatcccttgtcctcgtcgaatacgccgtaggcgcgcgaggtctccccgtgcggccagaagtccgacagcagcgggtactccagaccctcctgctccccgaagacccgcagggtgggcacggagtcgttggagacggcgaggagctgcacgtcgtcgttctggaagcgcgggagctggtcgcgcagctcgcacagctcaccggtgcagacgccggtgaaggcgaacgggtagaagagcagcaccactgccttctcgccccggaagtcggagagccgcacggtggcgccgtggttgtccttgagctcgaagtccggggccttgtcgccgacctcgatcgccatctctcgcatcccttcgttcccgcatccccgcgttgggctgttcgggtgagtcacagactaggccctgggtgcgggcggggcgggaacgcacacaccccgcggaccgggatcacctggtcggcggggtgtggttgcgtgtccgctcggctgcggctgcggctcagcgcttggccttggccgccttgggcgtcaccagcttggtggaggtccactccttaccgacgggcagacccttggccagggagaggccggccgtctcggcagcctcgctgatgtcgctggcctcgacgtagccgtcacggcccgtcttgggggtcagcagcaggatcagtgcgccgtcctcgaccagctctgtcgcgtcgaccagggcgtccgtcaggtcgccgtcctcgtcgcggaaccacaacagcaccgcgtcggcgacgtcgtcgtagtcctcgtcggcaagctcgctgacgagcttctcgacggcgtcacggaattcctgatcgacgtcctcgtcgtagccgatctcctggaccacctgttcggactggaaacccagccgggcggccaggctctccgcgtggtccgcggtcgcgctcacggggtgcctcctgctcatgttcggtgaatgtcttcggcggcgcgcgtacgcgcagcattgggcgtagtccacacgggcgcggcggatcgcgcaagtacccggccgtcgagaccgtcgaaacggtgacgattacggccgtctcgccgcaactttcagccttcccgtgtgcacctctcgtgattcatcccacaccattccagctcattcggcatcatcgtcgacgcttgggcctttcctacctgtttgagggacgaacggccttgcgaagtcggcgcccgtcttgggcgtaaggtgcggtttggccggactcgcaacggatccccgccgatccttccctcccggattccctgcggtttccagggattaccgggtggtaaagatgaagatttcggcccagcgtaagagcatgggaggcggcgcccacaggcatgcctcccgtacgagtcccccgacagcgaaggaacagcgtggcttccgcatccgatcgcaatccgatcatcattggcggcctgccgagtcaggtcccggacttcgatccggaggagacgcaggagtggctcgactcgctcgacgccgcggtcgacgagcgggggcgtgagcgggcccgctacctgatgctgcggctgatcgagcgggcccgcgagaagcgcgtggccgtgccggagatgcgcagcacggactacgtcaacacgatcgccacccgggacgagccgttcttccccggcaacgaggagatcgagcgcaaggtcctcaacgccacccgctggaacgcggccgtgatggtctcgcgcgcccagcgtcccgggatcggcgtcggcggccacatcgccacgttcgcctcctccgcctccctctacgacgtgggcttcaaccacttcttccggggcaaggacgagggtgacggcggcgaccagatcttcttccagggccacgcctctcccggtatctacgcccgcgcctacctcctggaccggctcaccgagcagcagctcgactccttccgccaggagaagtcgaaggccccgtacggcctctccagctacccgcacccgcggctgatgccggacttctgggagttcccgaccgtctcgatgggcctcggtccgctcggtgcgatctaccaggcgcggatgaaccggtacatggaggcgcgcggcatcgcggacacctccaagtcccacgtttgggcgtatctcggcgacggcgagatggacgagccggagtcgctgggccagctgtcgatcgccgcccgcgagggtctggacaacctgaccttcgtcgtcaactgcaacctccagcgcctcgacggcccggtgcgcggcaacggcaagatcatccaggagctggagtcgatcttccggggcgccggctggaacgtcatcaagctgatctgggaccgctcctgggacccgctgctggcccaggaccgcgacggcatcctggtcaacaagatgaactccacgcccgacgggcagttccagacgtacgccaccgagtcgggcgcgtacatccgcgagcacttcttcggcggcgaccagcggctgcgcgcgatggtcgagaacatgtccgaccagcagatccagcacctgggccgcggcggtcacgaccacaagaaggtctacgcggcgtacgcggcggccaaggcccacaagggccagccgacggtgatcctggcccagacggtcaagggctggacgctcggcccgaacttcgagggccgcaacgccacgcaccagatgaagaagctgacggtcgacgacctcaagcgcttccgcgaccgcctgcacatcccgatcacggacgcgcagctggagggcggggctccgccgtactaccacccgggcccgaagtcccccgagatccagtacatgcacgaccagcgcagcgcgcacggcggctacgttccgacgcgtgtggtgcgcgcccagccgttgcagctgccggacgacaagacgtacgcggccgccaagaagggctccgggcagcagtcgatcgccacgaccatggccttcgtccgcatcctgaaggacctgatgcgggacaaggagatcggcaagcgcttcgtgctgatcgcgcccgacgagtaccgcaccttcggtatggacgcgttcttcccgagcgccaagatctacaacccgctgggccagcagtacgaggcggtcgaccgcgacctgctgctcgcgtacaaggagtccccgaccggccagatgctgcacgacggcatctcggaggcgggctgcacggcctcgctgatcgccgcgggttcggcgtacgcgacgcacggcgagccgctgatcccggtctacgtcttctactcgatgttcggtttccagcgcacgggtgaccagttctggcagatggccgaccagctggcacgcggtttcgtcctcggcgcgaccgccgggcggaccaccctcacgggtgagggcctccagcacgccgacggtcactcccagctgctggcctcgacgaacccgggctgcgtggcgtacgacccggcctacggctacgagatcgcgcacatcgtcaaggacggtctgcgccggatgtacggcccggaggcggaggacgtcttctactacctgaccgtgtacaacgagccgatccagcacccggccgagccggcggacgtcgacgtggacggcatcctgggcggcatccaccgggtgtcgcagggcaccgagggcacgatcggggcccagctgatggcctcgggcgtggcggtgccgtgggcgctggaggcgcagcggatcctggcggccgactggggcgtccgggcggacgtgtggtcggcgacctcctggaacgagctgcgccgcgaggcggtcgaggtcgaggagcacaacctgctccacccggaggaggagcagcgcgtcccgtacgtgacgcggaagctgtcgggtgcggaggggccgttcgtggcggtctcggactggatgcgggcggtgccggaccagatctcgcggtgggtgcccggcgcgtacacctcgctgggtgcggacggcttcggcttcgcggacacccgcggcgccgcgcggcgcttcttccacatcgacgcgcagtcggtggtcctggccacgctcaccgagctcgcccgggcggggaaggtggaccgttcggtgctgaagcaggcggtcgaccggtaccagctgctggacgtgagggccgcggacccgggcgcggcgggcggggacgcgtagcgccttcggcgggccggagggatcgcggcgggcccgccggatccgtgtgcgggatcgtcgtgtgaacgggtcccggcttcggccggggcccgttcccgtttatgagttctttacgatgctcggcatgaaggaaccctcccgccagctgctgtgggagcggcggagccagaccccgctgctcctgctcgccgcggctttcgccgtggcgtacgccgtgcccatcgtcgcccccgacgcgagtgcgggcacgcaccgggcctgcacccacgtcgaatgggtggtgtggggggccttcgccgtcgactacctggtccggctggccctcgcggcggaccgcaggcacttcgtccggacccattggctggacctggccgccgtggtgctgccgctcgtgcagccgctgcgcctgctgcggctggtcgccactttgatgctggtgggccggcgggcccggatggccccgcagatccagctgacgacgtacgtggccggggccgtcgtggggctgctgatgttcggctcgctggcggtgctcagcgtggagcgggacgcccccgaagggaacatcaagaacctgggcgacgccgtgtggtggtccttcaccacgatgacgacggtcgggtacggggaccactcgcccaccaccggcctcggccgggtcctggccgtcggtctgatgctgtccgggatcgccctgctcggtgtggtgaccgccaacatcgccgcgtggttcatctcccgcttcgagcgcgacgaccgggcggagatgctgcagctggcggccatccgggaactgcaggcggaggtacgggcgctgcgcggcgaggtcgcccggctgggcggcgccccggccccggcgccggcgccggccccggcccccgccccggccccggccacgagctcatccgtggccgaggccggagcggtggtcgaggaccgggccgctgccgcggccgcggtggacctgccgaacgccctggcccagcgggaagctacctctcccacaccttgaacgcccgcacctggtagggcgactggggcagccagaccccgtcgcccgggtaggtctggaactcgcccgtctccgcgcactcggccgactggtaggtggtcaccgggcgcccggtgcggttggtgagcgactgggcgctggtcccggccggcagcgcggtgcagctgttgatgtccagggtgctcagctcgtgcgtccagcgggtgcccttgaactccggtttcgcccacaggcacagctgcccggtcgcgcaggccccgagggccggcgggcccgcggcgtgcgccgtggtggccgtactcgggatgaggacggtgagggccaggacggtcgcggcgagggtggtcgtggtggtggcgcgggggcttcgactcgtacgcatgacgggtcaactccttgttgacggcgggcgtccggacggtctccggagctccgtggacaccacgttgacctgcgacgacaggtccgcggaagagggtgcgggcgggtccaccctgataggcgaccgcccggccggaatcctccggcgaggccttcgtccctacggagttgacgcttccggaagcctgcgggccggtcccgtcggcgccccggccggggtgcgggcccgggcggtcccgacccgaacgtgtcaggcaggagcgttctcgcgggcaggggcgggggtcctcggacggcacgtcgcaaacggctcaacgcagcggccgccaccccttcggtcaccggtacgctgaccgcccactcggcgtcagaaaggagccccgcggtggtgatcgacgagcggtcggctacggccgcgccggcgaccggactgcgcgagcgcaagaaacggcgcacccggaacgcgctgctgcgcgccgccctcctgctgttcctctcccagggatacgaacgcaccaccgtcgacgagatcaccgacgccgtgcacgtgtcccagcgcaccttcttccgctacttcgccaacaaggaggaggtcgtcttcgccctccaggaactggtcgagtcgcggttcgtggccgagctgcacgcccggccggccgccgaaggacccttcgaggccatgcggggcgcggcgctcgccgcctgggacagcgtcgaggtggccctgtccgaggtggtcccggtcgatctctacatgcgcagctaccggctgatcgagtccaccccggccctgctcgccgtacacctgcggcgctccaccgagctggaggagcggatctcccggctgatcggcgcccgcgagggactggacgtggacgccgatccgaggccgcgggtcgccgtcgccgcgttctgcggcgtgatgcgggtcacgggacggctctgggggcggggcgaggacaccagcgtggagtcgatccgggggctgacggagacctacctcgaccggatcggcccggccctgacctccagttggcgcggtcccgcgtagccggaaggccgccgccgtccgctccgccggcgcgccgcgggctcccccgagcgggcctcacgcggtcccacggtcggccgtgagtcctgtcacccggcacctctgtggcgtaagacgtctcatacgctggtcacagtgaacctgcccggccttgcccaccccaccgccctcggcgccgacccgcgccctgccgcgctgcgcgccctgctcgcgctcgcggtggtcttcatcatgctggccaccaccggctggacggccgtgcaccggcccgaggagggcaccccgatgcgggtcgccgccctcggtgcctgggccaaggcccggatcgacggccgcccggtgccgcccgcggacgccccggcacggacggtggcgcgtttcttcgcgagcctcgacggtgcccagcgcgcccgtctcgccgacggctacccgctcgtcgtgggcaatctcgacggggcccccgcctccctccgctaccgggccaacctgcggggcctggagctggcccgccaggtcgaggagacgcgcagccgcgatgtcgcgctgacccccgccgaccggtccacggccacccggcgctctcaccgcttcgcctccctcgccgacccggcccggcagatcttcgccttcgacccgaccggcaacggccgcgtggccgaggtcttcggtgacctcaccggggccgagcgcgtctcggtgatcgtccccggggtcgacaccgacgtactcaccttcgagcggacccagcgccgtctgacctccccggtcggcatggccgagtcgctctacgcggcccagcgcgcggcccagccggacagccggaccgcggtcatcgcctgggccggctacaccgcccccaccggggtcggcgtggacgccgccacgggccgtatggccttcgacggcgccgtcctgctgaagtccctgaccgcggccctgcccgggaacgcgagcgtggcgctgttctgccacagctacgggtcggtggtctgcggggtcgcggcgcacgagctgccgcgccgggtgaccgacgtggtggtggcgggcagccccgggatgcgcgcggagaacgtcgccggactgcacacctcggcgcgggtctgggcgacgcgtgacgagggcgactggatcgcggacgtaccgcacctggaggtcggcgggctgggtcacggcgccgatccggtgtccccggcgttcggcgcgcggctgctgtcctcggcccgggccaagagtcacaccggctatttcgcgccaggtacggactcgatggacaacttcgccaggatcggaaccggcgcgttctcttccgttgtctgcgcgaccgggaacgatgcctgccggcgagggatttccgggacagagcaggactgacgcgcgtagaggcgcggaaatcggtcctcgcaaccggggggacgcgcgggggcgccgccgtttacgatgtgccgcatgggtgacgtactggccggaaaccatgccgtctgggagttcgactcggactcggtgctcatccgcttcgcacgggggatcagaacgccgaggctgccgagactctggcatgccctgggctcacgccggattcctctcgaagcggtgtccgccgtgacagtgaccgtgaccggaggcaaacgggacacggtggttctgcgtgccgtcccgcggccgggcgcggatccgctgatggaggctgccgccgggcagctcaaggaggcctgcgacccgtaccggctggtgctgccgggcgaccgggcgccggccgccgccgccttcgccgaggagctgcggtcccggctcggaccggatgccgcggaaccgtccgcgcgcttcctcgtcgacgtgccgccgccgccgctgcacctgaaggcgtacgacgcccgggtgggcttcgacggctcggcggtcaccttccagtggtcccgtaccggcgcctccaccagcaagtggaaggcgggcgaccaacgcttcccgctggccgcgctcaccggcgtcgagtggtgctccccggagggccccggcgggcacctgcggctgctgcagcgggacaccaccggtgatccccgcccggaccacgacctggcggcggccgtcttcggcacgggctacggagcggtgcacgagtcgctgccgttcgccgcggccgtcctggccgccctgcgcgcgcgtaccccggtcgccgccgtgccacgggcccgctccggcgacgaccggctgcggcacctgagcgagctgcacacggcggggctgctcaccgacgcggagtacgcggcgctgcgggaccggttcgccgccgagtccctctaagggggcgcggagggcccggagggcggctcagccctcgcgggccaccgaggtggagctcatgtccgggtagcggtcgccggcgacctgcgcggcgatcggctccagcaggtccagctcggcccgcgtgagggtgatccgggtcgcctcggtgttctcgcgcagccgcgcggccttgcgggtgcccgggatcgggaccacggtcagcccgtgcacggccgcccgctgctgcacccaggccagggcgatctgcgccgggctggccccgcgctcgcccgcgatctcccggacgggggtcagcagcgccgcgttggccttcgcgttgtcgccgttgaaccgcggctggtgacgccggaagtcgtcctgcgacagctccgcggacgcgtcggcgaaggagccggtcaggaagccgcggccgagcggggagtacgcggcgatcgccaccccgagctccgccgccgcgcccaccgcgctgcgctccacgtcccggctgaacagcgaccactccgactggagcgccgcgatcgggtgcacggcgtacgcctcgcgcagctccgctccggtgacctcgctgaggccgaggtgacgcaccttgccctcgcgcaccagttccgccatggcgccgaccgactcggcgaagggcacggccgggtcgcgccggtgcatgtagtacaggtcgatgacgtccacgccgagccggcgcaggctggcctccacggacgcgcggacgtagtcgcggtcgttgcggacaccccggtagtgcgggtcgtcggtgcgctccatggcgaacttggtcgccagcgtgatctcgtcccggtgcgcggccacgaagggcgccaggaactcctcgttgcggccccgcccgtagacgtccgcggtgtcgaagagggtgaccccggcggccagtgccgcctcaagggtctcccgggccgccgcctcgtcggtgtcgccgtagaactcgctcatgcccatgcagccgagcccctggacgccgaccagcgggccgcccttgccgagctcgacctgttcgagggtggtgccgtgctccgtcattgctgtgccttccccgagaccgttttcatggcatacatatcgatcttgtaatccagtacggcgagtgcgtccgtgagctccgtgatccgcgagcgcacctctcggcgcgtgcgttccagcagctcccggcgctccccgaccgtgtgctcgccctcgcggaccagctcggcgtaccgcaccatgtctgccaccgacatccccgtggcccgcagcttgcccacgaaggcaagccagtcgagatccttgtcggtgaagcgccgctggcccgagtgggaccggtccacgtgcggcatcaggccgatccgctcgtaccagcgcagggtgtgctgggtcagaccggtccgggcctcgacctcgctgatcgtgtaccgggtctgcgtcaggctctggctcatggctccacgctaaaacccttgagtgcactccaagcaagtaggctcggcggcatggacagcgtggaggccgggaacggcatggaaagcctgcggatcatcgagacctggccggtgccggccgccgcggcggccgtcgtacgggccgacgggagcctggccggctcccacgggcccgtcgaccaccggttcgccctggcatcggtcaccaagccgctcgccgcgtacgccgccctcgtcgcgtacgaggaaggggcgatcgagctggacgagccggccgggcccgaggggtccacggtccgtcacctgctcgcgcacaccagcggcctggccttcgacgagcaccgggtgtcggccccgcccgggcagcgccggctgtactcgaacgccggtttcgaggagctcggcgaccacatcgccaaggccaccggcatccccttcgcggagtacctgcaccaggcggtcttcgaaccgctgggcatggagcggaccaccctggagggctcgcccgccaaggacggcgtctcgaccgtctccgacctgctgcggttcgccgccgagctgcaggcgccgcggctgctggacgtccgtacggtcgccgaggccacctccgtcgtgcaccccgggctcaagggcgtcctgccgggctacgggcaccagtcccccaacgactggggcctcggcctggagatccgcggccacaagtccccgcactggacgggcgcctcctcctcgccgcgcaccttcggccacttcggccaggcaggcaccttcctgtgggtggacccggacgcgcgcgccgcgtgcgtggcgctgacggaccggcccttcggcccgtgggccgccgaggcctggaccccgttcaccgacgcggtactggccgagctccgctcccgctagggggccggggccgccggggccgcctcggcggcgaactcccagatcagcagctcccccggggatccggcgacgacctcgaggtcccgctcggcggtgatccgtaccgcgtccccgggacccagctccgccccgtccaggcgcaggtccccgcgcaccacgtgcaggtacacccggtccgcggcgggtacggcgacgcgctcgcccgcgccgggccgccgcacgtgcagtacggcgccggccgcggggacctcgtagggcgcggcgtcggcgatctcccggacgaccccgtacgagggctcgccgcccgcggcgaggggggcgagccacatctgcacgaagcgcagccgcccggtgccgtcgttgcgctccacgtgccgcgcccctgatccggcgctgagccgctggacgtccccggcccgcaccacgctcttctcgccggtgctgtcctggtgggtgagttcgccttcgatcacccaggtcacgatctcggtgtggctgtgcgggtgctcgtcgaagccggcgcccggcgcgagggtctcctcgttgcaggccagaaccgggccgaagcgcagattgtccgggtcgtagaaggagccgaaggagaaggcgtgccgggtggtgatcccggtggccgggtccccgccctcgtaccggtcggcgccggggcgaacatcaatcatggacgccacggtagaccccgccggtggccggggcgcggggccgcggtcgggaccggactccgcgtacccgtcccgataaggcagtcttgtcacgtgtcccaacccgaacgtgagcattcgcccgccccacatgccgcgcatcccgctcccgcccatccgcacaccgcgacgctccgccgactggagaagtccgcggggcggctggccgccaacgcgatcgcgcgcatggacgagaccctgccgtggtatcgggccatgccgcccgagaaccggtcctggatcggcctggtcgcccaggccggtatcgccgcgttcacggagtggttcaggcacccggagaccccgcaggccatctccaccgacgtcttcgggacggctccgcgcgagctgacgcgggccatcaccctgcggcagaccgtcgagatggtccgcaccacgatcgaggtcatggagaccgcgatcgaggaggtggcggccccgggcgacgagtcgatcctgcgcgaggcgctgctggtgtacgcccgggagatcgccttcgcgaccgcccaggtgtacgcgcaggccgccgaggcgcgcggggcctgggacgcccggctggagtccctggtcgtcaacgcggtgctgtccggcgaggcggacgagggtgcgctgtcgcgggctgcggcgctgggctggaactcgcccgagcacgtgtgcgtggtgctcggcacggcgccggagggcgacagcgagctgacggtcgaggcgatccggcgcgcggccaggcaccacaagctccaggtcctcacgggtgtgctcggggaccggctggtcgtcatcgcgggcggcagcgacaacccgatccaggtggccaagtcgctgatcggtccgttcgcggcgggtccggtggtggccggaccggtggtgtccgacctgctgaacgcgacgaagtcggcgcaggccgcggcggccgggctgaaagcgtgcacggcctggcaggatgcccctcggccggtcctggcggacgatctcctgccggaacgggccatcgcctccgatcccgccgccagggatcagctggtggaggagatctacagaccactggaggaggcggggtccgcactgctggagaccctgagcgtctacctggagcaggcgagcagcctggaaggggcggcgcggatgctgttcgtgcaccccaacacggtgcgctaccggctgcgacgtgtgaccgacgtcaccggatggtctccttctgatgtccgctcggcgttcacgctgcgaatcgccctgattctcgggcgtctggccgacggcgacccccagtcctagacttttgtcggacatcaacaattaccccgacggttcttggtccctgtccccacgggcggcagggaccatccacaagagagagtgtgagggtgctcgtactcgtcgctcccggccaaggcgctcagacgcccggcttcttgactccctggctcgaacttcccggtgccgctgaccgcgtcgccgcgtggtcggacgccatcgggctggacctcgcccactacggcaccgccgcagacgccgacgagatccgcgacacggccgtggcccagcccctgctggtcgccgcgggtctgctgtccgcgtccgcgctcggttccccggccgccttcggcgccgtcgcgggccacagcgtcggtgagatcaccgccgccgcctacgtcggcgtgctgtcggaggccgacgcgctgtcgttcgtccggacccgcggtctgggcatggccgaggcggccgccgtcaccgagaccggcatggccgcggtcctcggcggtgaccgtgacgtggtcgtcgcacacctggagaagctgggtctgacgcccgccaacatcaacggcgcgggccagatcgtggccgccggcacgatcgagcagatcgccgctctggaggccgacaagcccgaaggctccatgaaggtcgtcgccctcaaggtcgcgggcgcgttccacacgcaccacatggcccccgcggtcgccacgctggagaaggccgccgaggccctcaccccggcggacccggcgctgaagtacgtctcgaacaaggacggcctcgtcgtcaccacgggcgccgacgtcgtcgcccgcctggtcggccaggtcgccaacccggtccgctgggacctgtgcatggagacgttcgccgagctgggcgtcacgggaatcatcgagctctgccccggtggcaccctgacgggtctggccaagcgcgcgctgaagggcgtaccgagcgtgggtctgaaggccccggacgatctcgacaaggccgcggcgctcatcgccgaactgacggcctgagagaaggagcccacacagcatgtccaagatcaagccggccaagggctccccttacgcccgcatcctcggtgtcggcggctaccgcccgacccgtgtggtgcccaacgaggtcatcctcgagaccatcgactcgtccgacgagtggatccgttcccgctccggcatcgcgacccggcactgggcctcgccccaggagaccgtcgccgcgatgtcggtggaggcctcggggaaggcgctggccgacgccggtgtcgccccggagcagatcggtgccgtgatcgtctcgacggtctcgcacttcaagcagactccggccgtcgcgaccgagatcgcgcaccggatcggggcgggcaagcccgccgccttcgacatctccgccggctgtgccggtttcggctacggcctgaccctggccaagggtctggtggtggaaggttccgccgagtacgtgctggtcatcggcgtggagcggctctcggacctgaccgacctggaggaccgcgcgacggccttcctgttcggtgacggcgccggcgccgtgatcgtcggtccctcggacgagccggccatcggccccacggtgtggggttcggagggcgacaagtccgagacgatcaagcagaccgtgccgtgggacgagtacctcggcaaggacggcggcgagaagtttccggccatcacgcaggagggtcaggcggtcttccgctgggccgtcttcgagatggccaaggtggcccagcaggcgctcgacgccgccgggatcaccgcggatgacctggacgtcttcattccgcaccaggcgaacatgcggatcatcgactcgatggtgaagactctgaagctgccggagcacgtcacggtcgcccgtgacgtggagaccaccggcaacacctcggccgcctcgatcccgctcgccatggagcggctcctggcgaccggagcggcgaagagcggcgacaccgcgctcgtcatcggcttcggggcgggactcgtctacgccgcgacggtcgttaccctcccctagggccgggatccacatcccgccctgttccaccccagttagctagagaaggagcgccacatggccgccacgcaggaagagatcgtcgagggtctcgcggagatcgtcaacgagatcgccggtatccccaccgaggacgtcgagatcggcaagtccttcaccgacgacctggatgtcgactcgctctccatggtcgaggtcgtcgtcgccgccgaagagcgcttcgacgtcaagatcccggacgaggacgtcaagaacctcaagacggtcggcgacgccgctgactacatcctgaagcaccaggcctgagcctgacgagcgtttgtcgccacctggcggtggcgccgtgacaattcagcaccccctgagacgtggagaaagaattcctgtgagcccgaccaatcgcaccgtggtcgtcaccggtatcggcgcaaccactccgctgggtggcgacagcgcttcgacctgggaaggtctgcttgccggccgttccggcgtcaagcccctggagggcgagcgcttcgccgaactcccggtacgcatcgccgctcgggccgccgtcgacccgagtgaggtcctgccccggccgctggcccgcaagctggaccgctcggcgcagttcgccatcatcgcggcccgcgaggcgtgggccgacgccggttacaccactccggccggcgaagagacggacgagggcgccttcatcgctcccgagcgtctgggcaccgtgatcgcctccggcatcggcggtgtcaccaccctgctcgaccagtacgacgtcctgaaggacaagggtgtgcgccgggtctccccgcacaccgtccccatgctcatgccgaacggcccctccgccaacgtcggcctggaggtcaacgcccaggcgggcgtgcacactccggtcagcgcctgcgcgtccggtgccgaggccatcggctacgccgtcgagatgatccgttccggccgtgccgacgtggtcgtcgcgggcggcaccgaggcggcgatccacccgctgccgatcgccgcgttcgccaacatgatggcgatgtccaagaacaacgagaaccccgagcaggcttcccgtccgtacgacaaggcccgtgacggcttcgtactgggcgagggcgcgggcgtcgtcgtcctggagtccgccgagcacgccgccgcgcgcggcgcccgggtctactgcgaggtgctgggccagggtctgtccgcggacagccaccacatcgcgcagcccgagccgaccggccgcggtgtcgccgccgccgtgcagaacctgctcgacaacacgggtctcgacccggccgagctggtccacctgaacgcgcacgccacgtcgaccccgcagggtgacacggccgagctgaaggccctgcgcaaggtcctgggcgacgacctcgaccacatcgcgatctccgcgaccaagtcgatgacgggtcacctgctgggcggcgcgggcggtatcgagaccgtcgcgaccgtgctggcgctgtacaaccggctggccccgccgacgatcaacatcgacgacctcgacgaggacatcgacgcggacatcgtcgtcggcgagccgcgcaagctgccggccgacggcccgatctccgcgatcaacaactccttcggtttcggcggacacaacgtgaccctggctttccgcacggtctagtacccgcgcaggacacgcgaaaggcccacccggtgaatccgggtgggcctttcgcgtgtccgccggggctcagaccacctggtggagccagcggacgggagcgccctcgcccgcgtagcggaagggctccagttcgtcgtcccacggcttgccgagcagtttggcgatctccgcctccaggtcggtctcgccgcgtgcggaacgggcgagagcggcgcgcagccggtcctccgggatcaggatgtcgccgtgcatgccggtgacggcgtggaagatgccgagctccggggtggagctgtagcgctcgccctcggcggtcgggcacggttccgcggtcacctcgaagcgcagcaggtgccagccgcgcagcgcggaggcgagtttcgaggcggtgcccgcttcggcctgccaggagaactcggctctccaggtgcccggggaggcgggctgtctgatccagtcgaggttcacccgcaccccgagcacgcccgcaacagcccattccacgtgcgggcagagcgcgcgcggtgcggaatgcacgtacagaactccacgtgtcgtcaccgggacctccagtgtgggacgaggtcgggaataaactccagaaaacggacagtatgtgacgtgatgtaatgtaacggaaattatttgacattgcgctacggaacctgcggccgaaacgccacgggaaaaagctaccgtgcgccaggggtcatggtgtgacgtacggtcgctccaagacccgtaagcgcagagctttcactcagcaggaccccccgaacgatgcgggggcgacaaggaggggcccttcccatgcgcaccaccgctccacgccgccgcgcgcgccggtctctcgcgggcgcgggcgcggcggtcgtgctgctggccggggcggcgaccggctgcgactcgggcgggtcgggcgagcagggcggggagcggggagcgcagagcgcgccgcgctggaacacggcgcccacctcgatcgcggccgtcggcgactccatcacgcgcgggttcgacgcctgttcggtattggccgactgcccggaggtctcctgggccaccgggaacgacccggcggtccgctccctggccgcccggctgctgggggacgcccaggcacccgaccgcagctggaactacgcggtgaccggctcgcggatggcggacctgccggcccagctggccggggccgccgcgcacaagcccgacctggtcacggtgatggtgggctcgaacgatgcctgccggcccacggcttcgtcgatgaccccggtggcggatttccgggccgggttcgagaaggcgatggcggacctgcgggccgcctcccccgcctcccaggtgtacgtctccagcgtgccggacctgcaacggctgtgggagcagggcaaggacctgccgatggtgcggcaggtctggaagctggggatctgtcagtccatgctcgccgatccgctgtcggcggccacgcgggcgacgtcccggcgcgagcaggtgcgggcgcgggtggtggagtacaacgaggtgctgcgcgaggtctgcgcgaaggacgcgctgtgccgctacgacggcggcgcggtgttccagtaccccttcgcggcggatcagttgagccgctgggactggttccatccgggcaaggacgggcaggcgcggctcgcggaactggcgcaccgccaggtgacggcggccgaaccgccgcgttgacgcccgggccgcccggagggtccggggacgggtgtcaggtcccgtccccggacggttttcaggggtgatttccggccatacggcgtgtcacgcgaggtcgagcgtcgcggtcagccgggtgtcaccgtgcgagcggctcgcgcggacctcgtaggtgccgctgatccgccgccagccgcgggcctcctcgtcccagatctcgaaggcccgggcgggcagggcgatctcggtcgcgacgctctcgccggggcccgccgcgacgctcgcgaagccggccagccagctcgccgggcgctccacggagccgtcggcgggcgccaggtagacctggacgacctcgcggccgggccgggtaccggtgttggtgaggcggacccggaccgtgtcggcggtgacctccagggagtcgtacgcccagtcggtgtagccgagtccgtgcccgaaggggtaggcgggggtcacggcgtgcttctcgtacgcccggtagccgatgaagagcccctcgcggtactccaggcggccgtcggtggggacgacctcggtgacgggcgcgtcggcgaaccgggcgggccaggtggtgggcagccgtccgcccggctccgcggtaccgaggagtacgtcggccagtgcggccccgccctcctgtccggggaaccaggtcagcaggacggcggccacgtcctcacgccaggggagctccaccggggagcccgcgttgacgacgaccaccgtgttcgggttcacggcggcgacggcgcgcaccaggtcgtcctggcggccggggagggtcaggtcccggcggtcgaagccctcggactccacgcgctcggtggtggcgacgaccacgacggcggtgtcggcctcgcgggcggcggccacggcctcggcgatcagctcgtcggcgtcgcgcggcggcccgaggtggagcagcgagaacatgatcgccctgagcggcagggcgctcatgtcggggacctggaaggtcagtgacacctcgaccggctcgccctcggcgagggtgacgcgggcgcgttcgctgggggcgccgaagaaggcctcgaaggggtcggcctcgtcgcccatctcctggacgccgctccacagccgctcgccgcccaccgcgagggcgaaggcaccgagtccgcgggtgccgaaggcgtgctcgccgctctcgcgcggcacgaacgtcccgcggacctcgatgctcgccatcgtctcgtacgtgacgcccgcgggcaggtcgtcgccgatccactggacctggccggacggcaggccggcctcgccgaggacggtcccggaggcgtcgcggcagacggcgtggagctcgaagccctggccggcgggggtgagctcgtcggaggggtcggcaccgatggcgtaggtgagggcgccctcggggagggcggcggcgaggccgtcgagcggggagacgatccgctcggggaagacggtggcggagccgccgccgaggacgcgggcgtcacgggcggcggcgccggagagggcgacggtgccggcggcggcgtcgaggggcagcgccccctcgttgcggaccaggacgaagccgcgtgcggcgagctcacgggccagcgcctggccgtcgatcggggccgggggctcctcgacggccgccggggcgccttccaggacgccgacgcgggcggcgaggcgcagtacgttgcgcacggcctcgtccacggcggactcggggacctctccggcgcggacggcctcggcgagggcggggccgtagacggtggtggggccgggcatggccacgtccatgccgccgaggatgtcgccggtggtggagcgggcggccatccagtcggagacgttgcagccgtcgaagccccattcggcgcgcaggacctcgttcacgaggtactggtgctcggtcatcgtcgtgccgttgacctggttgtaggcggtcatgatgccccaggggcgggcatgggcgacgatggcctcgaagggggccaggtacagctcgcgcagcgggcggggggcgatgacgctgtcgaccgtgaaccggtcggtctcggcgtcgttgccgacgtagtgcttgacggtggtgccgaccccgccgtcctggacgccgttcacatagccggatccgatggcgcccgtgaggtacgggtcctcggagtagcactcgaagtgccggccgccgagcggggagcggtgcaggttgacggtgggcgcgaggaggacgtgcacgcccttgcggcgggcctcctgggcgaggagccggccggcacggcgggcgagttccgggtcccaggccgcggcgagcgcggtcggggacggcagggcgacggacgggtcgtcggcggtccagcgcacgccgcggaccccgatgggcccgtcggagaagaccagggactccagcccgatcgcggggacggcgggaagggaccacatgccctggcccgccaggatccgggtcttggtgtcgaggtccagtttgcccagcgccgcctcgacggcgtcgttgcgtatctgatcgcggacctgatcggcatcggtcacggccgtgcctcctcgttgagtgcggtgcggtgcccccatcgtggacctgttacctgttgaacggtagggttcgtaatgtgttcgtgacatttagatgccgtacggtcctgtgggcagggcgcagcgcgtgaagggaaggggtgcgggccgatggtcagggcgaggagcgaggagcgccgcggggagatcgtccgcgcggccgtcgaggtgatcgcggagcgcggctaccggggcgcgtccctggccaccgtcgccgaacgcgtgggcctgacccagcaggggctgctgcactacttcccgaccaaggaggccctgctcgtcgcggtgctggaggaacgcgaccgctgggacacgggcggcggctcgcgctccgccgccgacacctggcgcctggacctgctggactcgctggtcgagtacaacgccatgcgccccggcatcgtgcagaccttctccgcgctgctgggcgagagcgtcaccgacggacacccggcccgggaattcttcaccgagcgctacgcccaggtccgctcggagatggcggcggtgctgcgcgccgagttcggtgaccgcctcccgtccggcctcaccccggagcaggtggccccgctgctgacggcggtcatggacggcctccagtaccagtggctgctggcccccgaatcggtggacatgcccgccgccttccgctccttcctgaccctgctgcggggcccggacggcacccgggggtaggccgtcgctcccggaggcggctcagtcgatccggagctcgcccatccggctccagccgttcgcaccctcgatggtggtgctgacgatctcgggcgtacgggtcaccatcggccgcatggtctccagcgcggcgcggaagtgctccgaggtgacgtgcgcctcggcggcgtcgtcctggaaggcctcgaccaggacgtaggtgtccggctcctccaggctgcgcgaccactcgaaccagaggttcccgggttcggcgcgggtggcgcgggtgaagggcgcgaccttgtcgggccacgcgtcgacgtattcgggcttgacggggaatttcaccacaatgaagatcacacaggcagtttaggcagattgatccaccgtgacgggctcaactgcccgtgcccggcccggtcatgacaccggacacggccccgccatgcgagcggcgaatgtctaacatggcccgcatgccctcttcgcacagcctgtacgaggtcttcctgcgcgtggcccgcctgggctccctcaccgccgccgcccggtccctgggctacacccagtccgcggtctcccggcaggtccagaccctggaggacgagtgggggaccccgctcttcgaccggctgccccgcggggtccggctgaccgaggccggccgcgtcctgctcccgcacgccgaggccgtcggcgagcggctgcgcacggcccgcgccgaactcgacgcgctgcgcaccctcggcgccgggcggctgcggatcggcgccttctccaccgccgacgccgccctgctgccccgcacgctggcagccttccgggcccgccaccccgccgtggccgtcagccgcaccgagggcccctccgccaagcacctggccctgctcgccgccggggacctcgacctcgccgtcgtcgcctgcacctccgcggagccgcccggcggctgcaccccgcaccacctgctggacgagcggatgtacgtggccctgccgggcggccaccggctcgcggggcgtgccggtgtacggctggccgagctggccgacgaggagtggatcgcggccgacacccggcccgaggagaccctgatgcactccgcgctcgccggcggcttccgcccgcgcaccggtttcgtcgccgccgactggatcgccaagcagggcttcgtcgcggccgggctcggcgtcaccctggtcccggccctcgccgcctcctcggcgcgggccgacctcgcgctcgtccccctgcacccggacgacaccccgcgccgccggatctacgccgccaccccgcgcgggatcaccccctcccccgccgccctcgtcttcctggccctgctccaggaggtcgccgccgggctggcatcctgacctggtgaagatcgccgcagcccagctgacctgcacgcccgccgacgtccgcgccaatgtcgcgcgggccgcggacctcgccgccgaggcccgcgcgcagggggccgcgctggtggtgttccccgagctcgcgctcaccggctacgagctcgccgcgctggccgccgacccgggcctgtggacggccgccgacgacccccggctggatccgctgcgctccgcggggatcgccaccgcggtgaacgtggccctgcccaccggcggcccgcggcccgccctcgcgacgctggtccacgacgcggacggcgcgcacgtgacgacgtacgcgaagcagcacctgtaccggcacgagcaggaggtcttcgagcgcggcgaggccgacgggcgcttcgaactcggcggaatccgcttctccctgggcatctgcttcgacaaccacttccccgaactgcccggccggggcgccgccgacggctgccgggtccatctggcgagctccctgtacgggacgggggacgggatccgtgagcgcgccaccgtgcacccggggatcgcgcgggagcacggcctgtacgtggtcctcgccaaccacgtcggccgggccggcgcgtggaccggctgcggccgctcggccgtgtgggccccgggcggtgccctgctggccgaggcggacgaccgtacgccctcggtggtgacggcctccgtcgccacgggccgggtgtgatgaggtgggcgccatgagcgacttcgagacgatcacggtgccggaacacctccacggctatccgggggtggccttcggcggctacgtggcgggcgtactcgcctcccgcgccgccgccgcggacgtacgggtggacttccggcggcccgtgccgaccggggcgccggtgcggctcgccgcgaccgtggacggcggctgcgagctgacggacggcgagctgctgctggccgtggcgaccccggtcgggtcccccggcgcggacatccccgaagccccctcctgggaccgggccgtggcggccgccgaggccttccgggcggacccgccggacggtcagcccgactgcttcggctgcggcctggaccggacgcccgccaccgggctgcgcctgcactgcggtgccgtgccgggccgcgagctggtcgcctcggcctggacccccgcccccggactgggcggtgcggacgggctgctgccgcccgagctggtgtggggcgcgctggactgccccgggaacgcggccgggcggctgctcgacggccgcggggccggtgcggtcaccgccgcgctcggtgcccggctgctgcggccggttccggtgggcaaggggctgatctcctacgcctggatgcggtcgagctcgggccgcaagtacaccgtgggcacggccgtggccaccgccgacggcgaactgtgcgccgtcgccgaggcgctgtgggtgcagccgcgcacgtaggcgctcacgcggtgtcggccagcaggtgcttgccgccccacgcccccaggggcttcagggccgtattcaggtcctggcccagcggggtcagggagtactcgacgcgcggcgggacctcctcgtacacctcgcggtgcacgatgctgtccgtctccagctcgcgcagctgggcggcgagcaccttctcggagacacccgggacgagcctgcgcagttcaccgaaccggtggggccgctgatccagcacccacaggagcgacaccttccacttcccgtcgatcacggacatcgccgcggagatcccgcagtgttccgcaccaggccttcgtgccaccgcacacccctccccacctgctcgctcacctcggggtaaccacccactccgaagtgcgtacttgagcgctccaccgcccgccaccaggctaatcgtcatgaccgacaccacgccgcaccattccctcaccctcctcggcctcggcgacatgggcaccgccctcgcccgcacctggctcgccgccggacactccctgaccgtctggaaccgcaccgccgccaaggccggggccctggcctccgaaggggcgtccgtcgcggcgaccgcggccgacgcggtcgccgcgagcccgctggtcgtggtctgcctgctggacgacgccagcgtcggcgccgccctcgacggcatcgacctgaccggcaaggacctcgtcaacctcaccaccggcacgcccggcgaggcgcgcgcccgcgccgcctgggccgaggcgcgcggcgcccgctacctggacggcgggatcatggccacgccgacgatgatcggcgtccccgaggcaggcgggtacgtcttccacagcggctcccgcgcgctcttcgaagcccaccgggccgtcctggaggtgccggccggggcccgcttcgtcggtgaggaccccgggcacgcggccctgcacgacgtggcgctgctcagcgcgatgtgggggatgttcgccggtatctcgcacgcctacgcactgatcgcggacgaggacatcgccccgaaggacctggctccgctgctgtccgagtggctcggcgcgatgggcttcttcgccggcaacgccgccgagcggctgacctcgggggacttcacctccggagtggtgtccagcctggccatgcaggtcgtgggcagcggcaccatgctgcggaccaccgaggagcagggcgtcagcaccgagctggtctccccgtacgtggacctgctgcgccggcggctcgccgcggacccggccgcgcacggcggggaggacacgatgggggccgtcctgctgctgaagcggtaggcggcccgaaccgagacggcctaggagtacgcgggcggcggcggtccgaaacccgcgggggtggtttcggcggccggggcctcgtcggtccgtacgaggtcgcgggccatcagcgtggccccggcgaccgcgccgggcatcaggaacaccgcgaccagcggcaccaggaacgccagcaccagcggcaccccgaagcccagtaccagcagccggcgcgagcgcatcagctccagccggtcgggcagctccaccttgcgccgctgcagggccacggcggtcagctcctgggtcaggaagtaaccggagacgcagaagccgagcaccgggaccaccgtctgcccgatcaccgggaggaaaccgagggcgaagagcacgatcccgtacagcagcacgcgcgcgagcaccttgacgctgtcccgggccgagatccacagctccagccagagcgggagccccgactgcggcacctcgccgccctcgctgcggtcgacctgctccgagagggactcgtagaacggctggccgatcagcagggtcacggccgtgaaggtgatcaccgcgaggaagagtccgaggccgaagaacagggcggtcaggaagccgcggaagagcgagagccagggcgcggaccagtcgtcggcgaagggcgtggcccaggcggtcaggtcgtcggccccgtacccgagcccgatcagggcgccggcgtagaggacgagcgcgacgagcccgggcagcagcccgaagcccagccaccggccgtggcggaacacccatcgctgtccggccagcagataccggaagccccccgcaagatcacgcatggggccagtttacggcgaaggccgcaccccggtcggggtgcggccttcgcgctgcgagcgccggatcagacggcgagctcgacggtgatgttgccgcgggtggccttggagtacgggcagacctcgtgggccttctcgatgaggtccttggcggtggcggcgtccacgttcgggatcacggcggagatcttgacgatcaggccgaagccgtcgtcgttcttgccgatgccgacctcggcggtgaccgtggagccggagatgtcggcgttcacgttcttcgcgacgacgcccagggcgccctggaagcaggcgctgtagccggcggcgaacagctgctccgggttggtgccggcgccgctgccaccgagctccttcggcgggttcacgacgacgtcgagctgaccgtcgttggtggcgacgcggccgtcgcggccgttctcggcggtggcgacagcggtgtaggcgacgtcggactgctggatggacataaaggaaaatcctcctggtaatcgccgtgagtcgcgcccacgatcacgacggtgtgcagtgagcctaaccggtgaaagaaacgatcatctttccggtgttctcgccgcgcagcatgccgaggaaggcggaggtggcgttctcgacgccctcgacgaccgtctcgtcgtaccgcagctcgccggaacgcagccatccggcgacgtcctggacgaactgctgctgcagtccgttgtggtcgttgacgaggatgccctgcaggcgcaggcgcttgccgatgacctgcatcaggttgcgcggaccgggggcggcctcggtgtcgttgtagccggcgatcgcgccgcacagggtggcccggccgttcaccttcatcgaggagatggcggcctccaggtggtcaccgccgacgttgtcgaagtagacgtcgatgccctcgggggcggcggccggcagctgctcggcgacgggaccgttcttgtagttgaaggcggcgtcgaaaccgtacttctccgtgagcagcgtcaccttctcgtccgagccggcggagccgatcacccgggacgcgcccttgatcttggcgaactggccgacgaggctgccgacggcaccggcggcgccggagacgaagacggagtcgccctccttgaaggaggcgacctcgaagagtccggcgtaggccgtcaggcccggcatgccgaggacgccgaggtaggcggagagcggggcgagcgaggcgtccaccttgacggcgtgggcggcctcgaggtccgcgtactcgcgccagccgaaggggtgcaggacgtgctcgccgacggcgaagccctcggcggaggaggcgacgatctcgccgaccgcgccgccctgcatcggctcgtcgagctggaagggcgggatgtaggacttggcgtcgttcatccggccgcgcatgtaggggtcgacggacatgtacaggttgcgcacgaggatccggccggcggcgggctcggtggacacgggcacctcgcgcagggcgaagtcctcggcgacgggccagccctgcgggcgacggacgaggtgccactcgcggctgacggcggggatctgagacatgcggcgctcctggtcagaacgaaattgcttcactgggtgaaacaaccatgcgcctagatatttcatgttgtcaagtaaatgggtacgctggttccatgcccagtcgtcgcatagacccagtgaccatcgaagtcgtcgaactcatcggcgacgtcgtggcccgctatcacatggagtacgagcacgcggccgccagtcaccagctcaccggcgcccaggccaaggtgctcaacatgctcgccctggagcccatgccgatgcggcgcatcgcgctgaagctgcggtgcgagccctcgaacgtgaccggcatcgtcgaccggctggagacccgcggcctggtcgagcgccgccccgacccggccgaccgccgggtgaagctggccgcccccacggaggagggcacgcggaccgcggagcggctgcgcgagtcgctggacttcgcccgcgagccactggccggactgtccgcccaggagcggacggtcctgcgggacctgctcaagcgcatgctggcctgacggcgccacgcgggccaccaccggccggaagaatcttctggacgcgggcccgggaacggcataggttcagccgaccgcgcgccgggccctgcaacgggctgaccggcggctttgccatgtcatacattcccgtggggggtacaccgtcatgtccttcaacgcgcccggaacaccgccgccaccgcagtacggcgacgtcctgagatcgccccagggcctcgcgaccgcgctgaccgtgctcctgtgcgtggcgggcgggatcaacctgctctcggccgggaccaacgccttcaccctgtcgctgatgaacgacctcgacgcggaccccgcccgggtctccagctccatgaccgacctgtcggacatcctgaccggcctcgcggggatcttccagctgctggcgtacctcgccaccgccgtcgtcttcctcgtgtggttccaccgtgtgcgcgtcaacggcgagatcttcgcggccaccgccttcagcctgggccgcggctgggccgtcggctggtggttcatcccggtcgcccacctgttcatgccgttcgtcaccgcacggcagatctggcgggccagcacccagctgaagcccgacggctcccccgtccgggtctccgccgcgcccctcacggcctggtgggcggtctggatcgtcgcatcgatcgccggccgcatcagcggcatggtctacatgcgcgccgagaccccgggtgagcggggggccgccgccgccctcggcatcggctccgacctgctcatggtcgccgcggccgtactcgccgtcctcttcgtccgcaggctgacggacctgcagaacaccatggccgcgcagggcccgtacgcgcccgtacaggccgcgtacgagggggccccggccgcggctcagacgctccgctaggccgcgtccgcacaggagcgccggccgcccgaagggcgggccacgcggcgtccggcgccgtgcatcgcacggcggagggccgtccgtgtactggacgtactcggacgtgcccgacaacgcagcgaggtgcggtgccaggcgtcgcgtggcaggcgggactttgcggacacggccttagaaccagccgcagaagatccagcagttcttggtcggcgagggggtcggggtcggcgacgccggaggcgggggcgggggtgcctgcgtgcccgcggtggcgctctgcgacggcttgcccgacgcactcgcctgtacggacggccccgggccgggggtgcgggaggccgggcccgatgtcgcgggcgcgggggcggacgaggtcggacccggctgcgcggcgctcccggaaggcgccgcggccccggccgtcttcgtccccccggcggcggccttcgccgtggccttcccggaccccgtgggcgcgccggccgtcggagcgtcgggcagcggggcgggctgctgcgggccgtcgtcggtcagcaccacgttctcggcccggtccgtgcgctccccgtcggtggccatgcgggccaccgccatcgagcccccgaccgcgagcagcaggccgagcgagagcgacagcacggtcctgcggcggcgccggtgcgcgacccggcggcgggcaccggcacgccgctcgttcggtgaggacagcacgacgagcgagtcggcgaagacctcggccagtgcgggcgtgggcccggagtacggagcctcggcagcgggcacggcggccggcggggcggtggccgtggcgggtatcaggtactcggcgggggttccgcatccggcgcacgccagtgcgccgttgaggtgcctccggcatgcgtggcagtagttcatggcgcccgcaggctacgtggtctgcggcaacatccggatcccgagaacgtaaggatcctgtgtggaatcgtttccgccatgacatctttcgggccgaccggattccagttggtgctcttgcggcggatggccgacttccggccggacctcgccgacgaggcccgccgcaggctgggcgcctcgctcgcggatcagcgggaggcgaacaagcgctggcaggcgatggtccgctccccccgctcccgcgggtccctggcccggtaccgctcggtgctcggcccgccggagtccgccgagcgccgcacgatcggcgatctggagtgcgaggccctgctgtgggcgctgccgctctggccggacctgcgcttcgaggtgctggccgcgccggacggggccgtgtggaacgagtggctggtacgggccccgggcgcgcgggagcccgtactggagtcgccggacgatctgcggccctggtcggcgacggtggacgaggtggcgcgggccttcgccccggtccgcccgatggagggcaccgcaccgacccgctggcgcctggccttcgccgcgcgggggcggccgtgcgtggcggagttcacctacgggctgctccagcgccactccctggaggcgacgcccccggagggcgcctgctaggaggcgaggaaggcgcggaccccggccgaggtgccgtcgtcgccgagcaggtcgttgtgctgcagacagccgaccggcgtgttggcggctccggtcagcgggacgctgtcgtccgggttgacgatctcgtcgcagtgggaccagaaggtcgcgtacctcaccgcgcccggggtctcgtccccgctgttcaggttcttcaccacgtacgagccgggggtcatgtcccggcacgcctggtcccacagcgcgcaggcccaggcggtggaggtgccgcgattggggccggcgagcgagacccagtggtccaccgtggccgcgccgcccccgaacttcacgtaccagcggctgaccagcgagccgaaggagtgtgccacgacgtcgaccctggcggcgccggtgtcgcggcggacctggtcgacgtaggcgccgagccgcccggcgaggacctcgttgacggactggtgggtgtcgtagccgaaggagaagagctccgcgtcggtgtacccgtcggcgcgcaggtccgcgcgcagggctccccagacgcccgggtcggcgttgtagccgtgcacgaagaccaccggattgcggggagcggcctgagcgcggccggcggcatgggccggggcgggggcggacagcgtcaggcagagcgccaggagtgcaaggagcgccgggagtgctgggagtgccgaaagtggctgcgatctctgccgggccgtcagcatcgggtcccctttaccttgttacgcatgagtagcgcgtgcggtgcgggcatggtgctgcctgtcggtacagaaatccacccccatgcagccgcgacgcaccccccggccggagcatctcaacgggccataagaccgaatagcccgcgatgatatgaaaagtgaccggcatttccgtcggtccttgcgtcagcgctctcgggaggatctgccgtgaccgtcagtcttgagcagttgcgccgctgccacgtcgccgtcgacctgggggcggcaagaacccgcgtgtacgtcaagggcgccggcctcgtggtcgacgaacccagcgtcgccgcggtcaacacgcgcaccggcgcactcatcgccgtcggctccttcgccgaacggatgaccggccgcacgcccgactacatccgggtcgtacgccccgtctccggcggcaccgtcgtcgacatcgagatggcccagcggatgctgcgtcatctcctcggcgagaagctgcggcgcgccctgcgccgcaagccccggctgcgggccgccgcctgcaccccgcacgacgcggacccgctcgcccagcgggccaccgtggagaccctcgtcgggctcggcgcccggcgtgtcgaactggtcgacaccctgatcgcggcggccgtcggctgcggactccccgtggagcagccgaccgcgacgatgatcatggtgtgcggggcggcggccacccaggtggccgtcctctccctcgggtccatcgtcaccgcccagcggatcccggtcggcggcgaggccatcgaccacgcggtcgtccagcacctgcgccacgcgcacgagctgatgctgcccagccaggcggtccggccgctgcaactggccctccacggcaacggcctcaccgtcggcggcccggcctccaccctgatccacggccgcgacgtggccaccggcctcgcccgctccgtgcaggtggacaccgcagccgtacgggacgccatctacaccccgctgaccgccgtcctcgacggaatcggcaaggtgctgcgggactgcccgccggacctggtggccgatctgacggaccgggggatcatgatggtgggcggcagcgccctgctgccgggcctggaccagatgctgcgggacgccaccggaatgcccgtcgccatcgcggaacggccggacgtgtgcgccgtactcggtctcggcgcgatgctcgaagggaagatcgcccccatggtcctcaaccccctggccgaatgacggacacagggcaggcacccgacgaggagacggcgcgccttccggtgctgctggaggccgtcctcaacgtcgggtccgagctggagctgcacaccaccctgcagcacatcgtggactcggcgaccgagctgtgctcggcccggtacggagcgctcggggtcgtcgaccccgagcgctccgtactgacccggctgttcacggccgggctcaccgaggaggagcgggccgccatcccgcacctgcccgacgcgcgttccggggtgctcggagccctcgtcggcgacccgcgaccgctgctcctggacgacgtcgccgaggacccgcgggccgccggcttcccaccgggccatccgcccatgcacaacctcctgggcgttccgatccgggtgcacacggaggtcttcggcaacctctacctcaccgagaagcgcggcggtggccccttcacggacgaggacctcgccctgctgcgcgtcctggcctcgcaggcgggcatagcgatcggcaacgcccggctctacgagaccgcgcgccgccgggagcgctggatcgacggcgccgccgccgtgaccaccgccctgctcgccggacgccctgcggcggacgccctgcgctgcgtggccgagcgggcccggctgctcgcggacgccgcggccggcgtggtgctccagccgacccccgagggcggcatggagatcgtggccgcctccacgcagggggaccccggggacctgctggggacggccatcgcccccggttcgccggtactggtccaactgctcggcggcgaacccgtcttcatcgacgactcggcgacggacccccggatgaccacgcacgtccgggagcggttcgggccgagcatgatgcttccgctgcagagcggcggccagctgatcggcaccctggccctgccccgcgcccggggcggccccgcgtacgacgcggtggaccggctgctcgcctcgcagttcgcctcccaggccgcgctggccctcgtactggcggacgcccagcacgaccgggagcagctggcggtgtacgaggaccgcgaccggatcgcgcgcgacctgcacgacctggtggtccagcggctcttcgccaccgagatgatgctcgaaagcactcggcggcgggccgcgaacgcccccaccggggacacggtgggcgacgagctcagccgggccgtggacgagctggactccaccatccaggaggtccggacggccatcttcgccctccagcagccgccgaccgacgccccgacgaccttccgcggccgggtactgcgcgagacgggcggcgccgcggccgtgctcggcttccagccgtcggtgcacttcgcgggcgcggtggacgccctgctgccggacccggtggcggccggcctgctcggggccctgcgcggcgcgctggccgcggcgcaccggcgcggcgagatcaccttcatcgacgtacaggtggacgcgagcccgtcccgggtccgcctgacggtggcggacgacggcctcacggagtccggcgcgcggggcacgacggtgacgtgggagtcggcgctgtagccgggcggcggcccgccgggcccgcatcggaaacggctggtcgcgggcgtccgccccgcggttgtgcttcgatgcgccgatggacatcgaaagcgctcggccggccggtggagccccggtccggcaggtccggcctcggacggacggtgatctcggcgcgtgcgtccgggcactcgccgaggtccacgagcgggacggctaccccgtgaactggccggaccacccccgggactggctgtccggaccggcgctgctcgcggcctgggtggcggagctggacgggcggatcgtcggtcacgtcggcctctcccgcagtgcggcggacgatgcggcgcccgcgctgtggagcagccgcgagggcgtgagcagtgcggcggccgccgtggtcggccgcctgttcgtcgcccctgcggcacgaggccacgggatcggcgcactgctcatggcccgggcggtacgggaggcgcgggaacgcggcctgcatcccgtgctcgacgtcgtggcctccgacgccgcggcggtggctctctacgagcgtctgggctgggagctgctggccacggtcgaacagcgctggagcccggagcagaccgtgtccgtgcggtgctacgcggcggccgggtgaccgggagggatcagttctggcccggccgggtggccgcgcggagcgcgatgcgggtgttggactgggccacccccgcctcccgtttcatccggcggagcagcccgtcgagggcggcgggatcggcggcccgggcgcgtacgaggtagtcgtgctcgcccgtcacgtgcacgacctcggtgatcccggagagcttggcgacctgccgctcgaactcctcgttggtggtgtcctgccgcagcgtgacgtcgatgaagacgacgagcccgccggcggtgtcggcggccgggtccacgatcgtggtgaacccgcggatcaccccttcgcggcgcatccgtcgtacccggtcggcggtggcgttggcgctgaggccgacgcggactcccagatcccggtacgagatccgcgcatcctgctgcaggatgccgaggatttccctgtcgaggcggtccataccgcgattctcgcagccgggcccggtatgcgcgctcgtcccccgacggccgggcccgacgctcaccccatgagcgaactgatgacaccgacgctggccggtgcggccgcgggcctgggtgtggcgatgcccatgggcgcgatgagcgtgctgctgctccaggaggcgatgcgcgaccgccgcacggccgtggcggcggccgcgggaatcgcggcggtcgacctcggctacgcggccctggccaccgccgtgggcccctgggtggcctcccacatctccccggtcgaggcctgggtccgcctggcgtcggcggtgatcctgctggccatcgccgcccacggcctggccggagcccgccccaccggcggcggccacccggacgccgccgactccgccgcgtccggccccgcggcgtccggccccgggcgggtcggcgtgctcgtgtcggcgcggcccgggaaggccttcgtccggtacgtcgggctgaccgccctcaaccccaccaccgcgctctacttcgccgccctcaccaccgcccagggcgccgcgctgcgaaccggtgcggccgggggcgcgttcctcctcggggtcggcgccgcctcgctcctgtggcagcaggccctcgtggctctcggctccctcgccggcacccgtatccccgaccgcgcccgcgtctggaccttccgcctcggctacgggctggtcgccgcgtacgcggtgaagatcgccctcccgctcccgtgaccggccggccggccgaaggccccgtccaagtactgtcttccgtaaacgacttcgaccaccgtcgaccgccgacccgacctggggtgcccccgtgacgacccgtctctcggcccgcgcggccatcgcctccgtgtccgacaccggcagcttcaccgaactccccgcgcccgggcgggagtcgcccgccgacggccccctggggtggaccggctacgacgactcgcgcgcccgcgccgccgaacgcaccggcgagcgggagtccgtggtcaccggcaccgcccggatcggcggccgcgaggccaccgtcatctccttcgagttcggcttcctcggcggctctctggggcagcgcaccggggaccggctcgaagccgcgtacgcccacgcccgcgcacaccggctccccctggtctccctcatcgccaccggcggctcccggatgcaggaggggatgctcgcactcacccagctccagcgcgtggcccgccagtgcgtcctgacccgggccgcggggctcccccagctggccgtcctgcgcgacccgaccaccggcggcggctgggccaccctcggagccggggccgatgtcgtcctcgcgctccccgcagcccaggtcggcttcgccggctcccgggtacgtccgccggacgcggatccggccgcctactgcgccgagggccagtacgccgccggccatgtggacgccgtcgtacccgccgccgagctgcccggcaccctcgccgactggctccgcgtcctggccgcgccccgccccgcggagccggtcgaaccgccggccgcactggcggacgtggcaccgccgccgaccggctgggacgccgtccagcaggccaggcaccccgagcggccgcacgccgccgcgtacctggacgcgtacttcgagctccgcctgccgctctccggggaccgggcgggtggcaccgaccccgggatgctgtgcggattcgggctgcgcgagggccgcgccgtcgcctacgccgcccagtgcggcaccgccacccgcccggcgggataccgcacggccgcccgcgtcatccgcctcgcggaccggctcggcatcccggtgctcaccctggtggacaccccgggcgcggccaacgacgccgccgcggaacacgcgggcgcgggcccggccatcgccgacaccttcgcggcgctggccgaggccaccgtccccgtcaccaccctgctgatcggcgagggcggctcgggcggagccctcgcgctggccgcgccggggaacacctgggtcaccccggacagctacttctcggtgatcgccccggaactggcggcggccatcctcaagcggcccccgtcggccgcgccggccacggcggaccaactgcgcgtgcgcccccaggacctggtggccctgggggtcgcccgcggcatcgtcggcccggcgcgtaccccctgagcccacggccaccgccggctgccggacgtgatccgctactcggtcgcacgccggtccgacccgggggatcggtacggaggccgccggatcgcccggctcatcaggagtggatgatgccctgggtggcgcggccgtcgccgtcccagtcgccggtgaggggggtgtcgccggcgtcgccgtaggtgacggaggtgacggtgccgtcgtcgtgacggaagtagaaggtgcggttggcgggcatgtagacaccgatgttggtgcggccggtgtggtcccagtcgcccgccagcggaatgttgtcggagttgccgaaggtgacggtctggtcggcagggccctcggtgttgctgttgcgcaggtagaacgtgctggtggcgggatcgtaaaggccgacggtcaccgttccgttgccgtcccagtcaccggcgatcggccgccagtcaccgccgttgccgaaggcaaacgaggagaccgtaccgttgtcgtgacggaggtagaacttgcccgtgtcgggcatgtagacgccgatctgggaagtggtcccgtcccagcggcccagcaccggacggttaccggcgttgccgaacgcgagcgtggcctgcgccgtgctccccgaattcgccaggtagaacgtcgaggtcgtcggatcataggccgcctgcgtgtccttgccgtccccgtcgaagtcacccgccagcggaaccatcggcgtgttcccgaacccgaactccggacgagtcgacacacccgaacccgcattgtccgacaggtaccagccgagctccttgaccggcggctgcggaggggtcacgggccccgggtagggattctcgtggtccgccccgagaccggccttggggccgcagctcggccaggcacccgggccctgcgaagcgaggaccttctcggcggtcaggatctgttgctgcttggtggcctggtgggcgtagggcgcgtactggccgccgccgtaggcgagccaggtggacggggagaactggaggccgccgtagtagccgttgtgggtgttgatgctccagttgcctccgctctcgcactgggcgaccttgtcccaggtgcccaccgaggccgcggaggcctgtccggggccgaggacgaccggggcggcgagggcgagcaggacggtggcggtggcgagtgccgacttccggcggatggtggtcatggtgtatcccccctgggacgtggagttctcgtgtgtggagccgcacggggccccgggtcccgccggaatcagcgggacccgcgaaggtggagcggggttcggtgttgcgtcaccactggccggtgaggggggtgtcacccgggacaccgaagcggacgctgtagatgacctggtcggaatccttgccggcaccgaagaagtcagaatcccggtagacgccgaccttgtccgtaccgtcgccgttccagtcacccttgatcggggtgtcccccggattaccgaacttgacctggtgattcaccggcgcactcgtctgggaatccgtcagatagaacgtctggtccgaaccccggtacacaccgaccgtgtccttgccgtccccgttccagtcacccgtcatcggcgtgtcaccctcgacacccatccgcaccgaatacgccgcaacccgattgtcattgctcagatagaacgtctggtccgccgggtgatacacaccgatcgtgtccgtcccgttcccgtcccagtcacccaccaacggaacatccccaggactcccgtacatcaccgaaatcgcagtcgtaccattgtcattgctcaaatggaacgtcgaatcccccggacggtacacaccgaacgtgtcctgcccatccgcattccagtcacccgtcaacggcttgtcaccaggaaccccgaaaccagaccacccgtacaaaccaccactacggtccgccacatagaacttcgcctcgtccgaccggtacacacccgcgttggtgggagtggcgtcctcgatgatgttcttgtagcggtaggggatgtaggagctggcgttgttgaagtaggcgtaggggatgacgcggcgcacggcgttcggaggggtctgctcgatgccgatgtaggaggtgtgggacgcgtcggtccactgctcgaagatggtgacgtgcgaaccgcgctccgggttggaggggttgtggaagagcagcatgtcgcccttgcgcaggtcgttcttcgatatgcggtccgcgaaggtgtcgaggttgccggtccaggcgctggtgccgaggttccaggccatggagacgaggccggagcagtcggtgcggtagccgtcgcggtagttgttcatgctgtacgggaccttggcgtcgacccaggtcttggcccgggcgatgaccgcgctgcgggtgatcggggcggcggcgctctgcgcggccgccgcgccggagaaggtgctcttgccggccccctcggtcttgaggggctccggcttgccctgcggacgctcgacgtccgcggtggcggcgaccgccgcgacggcggcggcggacggctcgtccacctgggcggcgttgacgggtgcggaggcgaggacggccgtggcgagggagagggccacgagggtgccggtggcgcgggccacgccggacttgctgggcatgaagtctccttggaggcagcgtcggtcgacgggccggccgttgggcctgggcgccgccggaagagcggggaagacaggggagagaggccggccggccctcgacgggcgggcggaccgcgatgcgcggggcctcgatcaggggtggaacgtgacggagtagccgtggactccggtgccgcccgaggcgagcgtgtcgacgacgaggcggcggactttggcctgtgcgatgtcggtgcgggcggcgcggatgaagaggacgatcccgatgccgtccggatgcgtgcgggccctgatgtgttccatgccgcagtcgggtgtggcgtgggcccacagggcgtcgaccagggcgtgtgcctggtggtcggtcggcagggttcctcccgtcggcatcaaggtgagatggacgggtagcaccgcggggtcagtcccagccgatgccgttgtccgacgcgcccgccgcggacacggacaccgtcgcgtgggccgggatgacgtcccagccgatgcccttcgggtccgtcgccgtcgtggcggcagacgcgaggggggccgccacaccggacaggaccgaggcggcgaagacggtggcgagtaggcgggcggtcgtggacatggcggtttcccccaggtgtgacgtgagcaggaagttcgggacaggcggttggcgccgtggcccccgggtccggccgggagttgcctcccccgccgttccggtgagcactatcctgccgaccccgaagaccccggggaaggcgatgcggacgtcagcattaggactggccgcatcaggacgcggcccccgccgacctgcggcgatgccccctaccggacctcctggcccgccgcccgccgcaccgcctcggcgcccccgcggggcaactgcccgtaggccgaggcgaccttgagcagccaggccacctcctcggcgggcgtcctgctgtgcgccgggggcggcgcgggggcttggcaggcgtccggctccccgtggagcaccgagaacagccactccgcctccgcccgggcggtcggcaccccgcctccggggtgtgcgtcgccgggggcctccgcgggctgctgcgcccccgtcgccgcggagcggtcccggaggacgaggcaggcgtcgcggatctcgaaggcccggtgggccacgtcgagggtccggtcccctgtgacgaacaggtcgcgcgtccggcccatgcgcggtccgaacgcgaccgacgggacggcgtggagcaggtccgaccacagcgggtgcaggcgccacagcgcgtactggtcgccgacgtagcggacgagcgtccgcagcggcggcaggcccacgcccacgaggatgaggaggagggagatcaccgggaggatctcggaaacggcatcgggggttccgcgccccgggacgtccggccggctctcctggtgggcgaggaacaccacccggtacatggtgtagacgaagcccatcgcgccgccgccggccaggcacacgactccggcgcgcaggagtcccgcgggcacgctgcggcggttcgaccagaagagcttcgccgacagggccgtggcgatgccgaggtagacgtagacgatgctctcgtacaggcgcaccgccgggtcgccgaggtgggcgtcggtcacccgggtcggcggggcgccggggtcgtgctcgaagaagaagacgaacagcacggtgagggccagagcggcggccgccacgaaggcgaggcgcagccacacggcccccgcccggcgcggtccgcggccgtggaccgcgatcacgtactccacggcgcagtagttcgacgccagcccggcgaggtgtttgaccagcacggacaggtcgggtgacccggtgaggccccggatgaggaggtccacctcgggcggtctggtcgtcagtgcgacggcgatcgcggcgaggaacccccacaggaaccgggaggcgcgcgtgccgcccagggcggagggggcacgccagagcaccatggcccacatgagggcgggcagggtgaagtggtatatggagtacatcagttgccccgccagcggcgcatacggcgcaccgggtgggcgaggctggtggccagccggcgtgaggagggggtgccgacccggtcggcgccggcgaggtcggccaggagcacggcgatcatctcggcctcctgttcctcgacggaggcgaagttgatgcgcgcggcgccgagcgtccgtacgacgaggtccggggtcagttcggagagggcctgtgcgagctgggccagttcgacgttgtgggtgtgcccgcacagcacgtggccgagttcgtggagcttgatcaggtcctggtgggccggactggtcttctgctcgtagaagatgacgtccaggctgggcagggcgatccacgccccgcacggtgaggcgaatccgagatcgggcagcggctccatcacgatcgggcgtccgcggtggcgggccagtgcgtccctgaaggagtcgaccgtgaacgggtccggcagctcgatttcggccaggatgccctcgcaccgtcttcgcaggccccggggtacaggcatggcggcagcgaatccttcggtctgcagtagatcagcggtcggtgaggtgccctcaggctactaacgatctctctcagcagccgctttgggagatccggtcgggggcgccgccgccgtccccggccgcctccgcctccagtgcgctcagccggtccgcgagcgcggccagcatgtggaggctgttgtcggacagacccgaggcacgttgtgcgaggccgatgacgccggcgtttccggcggccgcgcggatgttcgccaaggcgtccagggcgagcaactgctcgtcgacgactgcggctttggcgtcgtccaggaagtacgtcgccccgcagcggatcccgaacgcgaggcccagccagtccagggtctccacggtggggttcgggggctggcccttctgcgtggtggcctggtgcagattgcggatcgtgtcccgggagatgacgccgcgtccggcgatccggttgacccgctccgccagctcccggtaggcgggggccttcccgcccgcccgggcggtctcctggacgatcagccggtcgagccgctcggagatcttctgagcgcggtcgggcagcgacgatgggtgctcgcggcccccacctgctcctgcgtccatcccagccagctccgatccgtcggcgaatcacgatacccgcaagcctgatggcgattttactagccacgccacccattgcccatcatgagggacttgggacatttattggccggaagtcgtcgggctgattggcgctcgcgggggtgggccgtaaggtcgtggcgattgtaatcgtcgcatggctggggggctgggcggatgctggatgtactggggctcgaccgcggggtggaagcggtgtaccgggcgatgctggcccacccggagggcagcgtgcaggatctctgcgaccaactgggcgtaccggaaagcaccgtgcgcgacgccctggacaagctcgccgacctgagactgctgcgcgcctcccgggacgtcctgggcgagatgcggccggtcagccccgaggtgggcctggaactgctcctgcggcgccaggaggaggaactcctgcgccggcggcaggacctcgagctcggcaaggccgcggccgcacgggcgatcgccgagtacgccgacctccgccccgccacccggaccgcgaccagcgagcgactggtcggcctcgacgccatccaggcgcgactggagggcctcgcccgggagatgtccggcgagtgcctctcggtgatgcccggcggagcccagtcccaggccagcctcgacgcgtccagaccgctcgacgacgccgccctcagcagggggatctccatcctgacgctctaccaggacagcgtgcggcacgaccccgccacgctcgcgtacgcgcggtggacgaccgggcgcggcggcatggtgcgcacctgtccgacgctcccgccgcgcatgctcgtcttcgaccgccgggtcgccgtcgtgccgatcgacccggccgacacgaagcgcggcgcgatctgcatcagcgaagccggggtcgtcgcctccctggtcgccctgttcgagcagacgtggcactccgcggtcccgctcggcgccgaccgctccaaggacacccgtaccggtctcagtacggcggagcaggaactgctcacgctgctcgcgtccggcctcaccgacgaggtcgcggggcgtcggctcggcatctccgcccgcagcgtgcggcggcagatggcggggctcatggagcgcctggacgcgtcgagccggttcgaggccggactgaaggcggcccagcgcggctggctccagtagcgccaccgcagttctcccgcaggacttccccctggccttcacccccggccggagcgggcgaaccgcgccgggctggtccccacgtgccgcccgaagtgccgggtcaggtgcgcctggtcgtagaagcccgcggccgtcgccgcctccgccggccgcatccccgccagcagcagccgccgggccagctccacccgccgcccggtcaggtacgcgtgcggcggcagcccgtacgccgccttgaagctccggatcaggtgggtggggtggacacggcccagctccgccgaagcctcctccaggccgatcccctcggtcacccgcgcgtcgagcagctcgcgcagccgtacggcgaggcccgcgcccggcgccccgtacgccgtcggcgcgcggcccgcgagccaccggtgcagccgttcccgtacgaaggccagccgcgactcggcctccagccgctcgaccgccccggccggcagctccggcgcgcccagcgccacgtgcaggccgtgcacgcgctcgcgcagcgccgggtcgagcagcagcggggcgtcgacggcggccccggtcaggccttcgggcaggacggaggcgtcgaggtagaggacgcgcttgcggaacccggcctcggtgacggtccgcccgtcgtgggccaccccgggcggcagcaggatcacggagttccggagcccgacgccgtggcgctcacggtccagggcgaagtcgacccgcccgccgtccaggatcatcagcgcccaggtgtcgtgcacgtgcgtcggataggcgtggtcggtgaaccgggcgtggaagacctcggcgatccccgcgaccggcggctgccaggcggagacggtgctgcgcgggcgtatcgcggccatgtcaggaacgtacaagaccgcccgcgggggtggcgacaggctgtccgcatgacgacacacaaggtcaacatcgccgagaagctggccggattcaccgagctgtgggcgccgcgccgcatcgcccgcgtcaacgactacgaggtcaaggccgccaaactgcggggcgagttcgtgtggcacagccacgaggacaccgacgagctcttcctcgtggtcagcggcaccctgacgatccgcctgcgcgacggggacgtggtgctgggccccggcgagatgtacgtggtcccgcgcggggtggagcactgcccggcggcggacgaggagacggcgatgctgctgttcgaaccgaccggcaccgccaacaccggtgacgtgggcggcgaccgcacccgggatccggtggacgcgtaggcgatccggcgggtcggggccggttcagagccggttcagggccggttcaggcttgggggaagcgggcgtcgtagcgggcgaagtcgcgccagcgcagcgcgagcagacccagtaccaggacacaggccagcccgccgcccgtgacggccacggccggggagatcaggtcggcggtggtcccggcgaggaagtcaccgagccggggcccgcccgcgacgacgatgatgaagacgccctgcaggcggccgcgcatgtcgtcgggggtggcggcctggagcatggtggtgcggaacaccattgaggcggtgtccgcgtagccggccagggccaggaagaacatgccgagccagaggttccgggtgatcccgaacaccgcgacggccagcccccagccggcgacggcgagcaggatcgccagcccgtgccggcggatgcgtccctgccagccggagaacagcccgcccagcagcgccccggcggccatcgcggcgaccagcaggccgaccgtgccggggccgccgccgaaccagagcccggcgatggccgggaacagtgcgcggggctgggcgagcaccatggcggccaggtcggagaagaaggtcatccggatgttgggccgggtgccgaggaagcgcagtccgtcgagaacggaggcccttccccgcgcgccctcggcccggtcgggcttcatcggcggcagcttccacatcgcgtagagcgcggcgctgaaggtgacggcgtcgatcaggtaggccgcctcgtagcccgcgacggtgacgatgaatccgccgagggccgggccgaccatcgagccgaaggtcatggtcacggagttcagggcgttggcggcgggcagctgttccaccgggagcagccgggggatcatggcggaccgcgccggtccgctgagcgccccgcagaccgcctggaacgcgacgacggcgtacaggaaccagacgcggtggaagtcgagcagcgcggcggcggcgagcacgaccgacagcgctgcggcgcccatcgagctgtagaggccgagcttgcgccggtccacggtgtcggcgatcgcgccgccgtagaggccgaaggcgacgagcgggacgagcgagaagagtccgacgagcccgaccgagaagctggaccgggtgatgtcgtagacctggagggagatcgcgagggtggtcatcgcctggccgacccaggagatggttccgccgaaccagagccgccggtagtccgcggatgcgctcagcggagtgaggtcggcgaatatgcgctgccagagctggggtggggcggtcgtccgggtcacagcggatgataaccaccggccgccggccgccctcctggatttttcggcccttcacacaccggcaacagtcgccacatccggctccgggctcccggcccggatggcgcattgccggtaactcgccactatcaccggacatttgactgaatcgccgtgcgctcctcacctcgtgttcagctcatgatgaaaagactcgtatgtccagggaggcgtagtgatcgaacctggcaacagcaacacgagcaccggcactggcactggcactggcactggcacgacgcagaacacggtgcgcaccaccgtccccctcaccgtcggcgtcgaggaggagttcctgctcgtcgacgcccgcagcttccgggtggtccccgccgccccgctggtcctggcgacggccggcgggctgcccggcgaactccacccggagggcacccgctaccaggtggagatctccaccccgatcgcccactcggcggcttcgctgcgcaccgagctcgccgccctgcggcgtaccctcggccgggccgcccgggcccacggatgccggctgctggccgccccctcgccggtcgtcgccgtggaggggccgctgcacctgaccgacgacgagccgcgccagcgcgagcagcaccgccgcttcggcgcgctcaccgacacgctggtcagctgcggccgccacatccacatcggcacgctcgacgtggacacggcggtggccgtctccaaccggatcagaccctggctgcccacgctgatcgcgctggccgccaactcgccgttctggggcggccgtgacaccggtcacgccagctggcgggcgatggcctggtccggctggccctcggcgggcctgcccccgcacttcacgtcgacggcgcacttccggcgctcggtgcagacgctgctcggctccggggcggccctggacaccaagatggtctactgggacctccgcccctccgggcactggccgacgctcgaaatccgggcgcccgacatgtccccggacatcgacacggccatcctgcaggccgaactggcccgcgcgctggtctccacggcgctgcgcgagatcgcggagcggcgccccgaaccggccgtacgggacgacgtactgcgcctcgcgcgctggcgggcggcccacgacggcctggagggcttcggcctcgacccgtactcggggacggagctccccgcggcggacctcgcggaggccctgctggacctggtcgccccggaactgtccgccgcgggcgacctcgaccacgccgccaagaccctggcgggcctcctgcgcgacggctcgggtgcccaccgccaacgggtggcattcgcccgccgccaggacctgacggacgtcctgcgtcacctcacggacgaaacggaggacttctgaccccaccccggcccgtgcgaaacggtgcccggaaacgccgaagccgcaggtgcgatcgtttctgcacctgcggcttgtggtggggcgggtgggactcgaacccacggccgacggattatgagtccgctgctctaaccggctgagctaccgccccttcacggcgtggcgcgtacacgtgtgcgcgccgtctgccgcagcatagccgctcatacgatctcctgcctcggatgcctcgcatgatcggcttcgcctgttcagagagaccgcgctgagggctgtccggttcccggacggggcgacaaagaaaagaagaggacccctcggggtcctcttcttcttccttgctcccccggctggactcgaaccagcaaccctccggttaacagccgaatgctctgccaattgagctacaggggaccgcgctcccccgactggactcgaaccagtaacctgccggttaacagccggctgctctgccaattgagctacaggggattgctgcggtgcatcgaacagcccacctccggcgttgccggggggcgagtgcccgttgcgagtcatagattagcgcaagcaggggggtgctccgccaatcggtatcggcagcgggccgggcaccacacgacgaagggtgacaggcatgcggtacaaggtcacgttcgtggtcggactggccctcgggtacgtgctcggaacccgggccggacgcgagcgctacgagcagctgcggaagtccgcacgccagctcgcgcataaccccgcagtgcggaacgccgccgagaccgcgggccagaccgggcgcgagtacgccggcaaggccttcaccgcggtgagccacaaggtcggcgacgccgtccccgactccttcgccgggcgggtacggagcctgcgcggccgggccggcggcggcgccggcgaggacgactggggtacgagcaacacgtgagctgacaggtccgtgccggggcccacgggatccatgaggttccgggggctccggaccggtcgactccggccccgcgtgcggcagaattcaccgcatggggatagtcgccgggctggacagctcttccgcgttcacacgcatcgtcgtctgtgacaccgagaccggcgccgtgctgcgccaggggtacgcaccccatccacagcccgcgggtgaaccggagggcggcaatccccacgagaccgacccgcaggcctggctgctctcgctcggcgaggccgccggcggcgggctcctcgaaggggtccaggccataggggtctccgcgcagcagcacggcctgctgccgctggacccgcagggcgggctggtgcgtcccgccctcgtcggcaacgacaagcgcggccaggtcgccgcggccgacctcatcgaagccttcggcggccggcaccgctgggtcgaggcggtgggctcggtcccgcactccgcgcagcccgtcgcgaagctggcctggctggcccgcaacgagccggaggcggcccgccggatcgccgtgctgatgtccccgcacgactggctcgtctggcagctgctgggccgcccggcccggcggaccaccgaccgcggcggcgcctccggtaccgggtactggtcggcggccaccggaacctggcgccccgacctggtcgagctggcgctcgggcaccgggcgctgctccccgaggtgctcggccccgccgacgccgccgggaccacgcccgaggggttgctcatatcggccggcaccggcgagacgatggccgccgccctcgggctgggcctgggccccggcgacgcggtggtctcgctcggtgcctccggttcggtgatggcggtgcaccacgaggcggtgtcggagccgggcgggctggtcacctcgatggccgacgccaccggcatgcacctgcccgtggtgaacacctccaatgccgtacgggccctgcgcggcaccgccgagctgctcggcaccgatctggaggggctgtccgagctcgcgctgaagtcgacgccgggcgcgcacggcctcgtactcctgccgtacctggagggtgagcggaccccgaacctgccgcacgccgccggcaccctgtccgggctgcgccgggactcgatgaagccggagcacctggcccgggccgccttcgagggcatgctgtgcgggctggtggacgcgctggacgtgctgcgctcgcgcggggtcgagatccgccgggtgttcctgctgggcgcggcggccgagctgcccgccgtgcaggtggcggcccccgggctgttcggtacgcaggtcgtcgtgccggcgccggccgactacgcggccctgggcgcggcgcgccaggcggcctgggcgctgggtgtggcgcagggcaccctggccccgcacaccccgccggtgtggccgtcccccgcggcccaggtcttcgagccaggcgaggagttcccggcgtggcagggggtgcgccagcagtacatcgccacgcgcgagcagatccacccgggggccttctagcgggcaggacaccccctgggcactccctgggcactccctaggtcgcgagtcggggcggtctggtccttttgaccggcctttgcgaaatccggtggggatcacagggccggttggaccaatatgggttgaacccctcgatcatcccgaccggagcctgcgcgtgctcatacgacttctgcggacccatctggttccgtaccggaaacccatcgcggtgctggtcctgctgcaactgctgcagaccagcgccagcctctacctgcccaccctcaacgccgacatcatcgacaacggtgtcgtcaacggggacaccggctacatcctgcgcttcggcgcgctgatgctcggtgtctccctcgtccagctcgtctgcaacgtcggagccgtctactacggcgcccgtacggccgcggccttcggccgggacctgcgcgccgcgatcttcgaccgcgtgcagagcttctcggcgcgggagctcggccagttcggcgccccgtcgctgatcacccgtacgacgaacgacgtccagcaggtccagatgctggtgctgatgaccttcaccctgatggtctcggcgccgatcatgtgcgtcggcggcatcgccatggcgctctcgctcgacgtgaagctgtcgggcgtgctgctcgcggtggttcccgtgctcgggatctcggtcggcgcgatcgtctggaggacgcgcccgctgttccgccagatgcagacgcgcctggacaccgtgaaccgggtcctgcgcgagcagatcaccggcaaccgggtgatccgcgccttcgtccgcgacgcctacgagaaggaccgcttccgcgaggccaacgccgacctgaccggcgtctcgatggccgccggcaagctgctcgcgtacatgttccccacggtcatcgtggtcgtgaacatctccagcgtcgccgtcatctggttcggcgcgatgcgcgtcgacagcggcggcatggagatcggccagctgacggccttcctcgcctacctgatgcagatcgtgatggccgtgatgatggccaccttcatgttcatgatggtgccgcgcgccgaggtctgcggggagcgcatccaggaggtcctggacaccgactccagcgtggtcccgcccaaggacccggtgcgcgaactcgcccgccgcggccgcctggagctgcgcggcgccgacttccgctacccgggcgccgaggcgccggtcctgcgcggcgtggacctggtggcccgccccggcgagaccacggcggtgatcggctccaccggaagcggcaagtccaccctgctgggcctggtcccgcggctcttcgacgcgaccggcggcgaggtcctcgtcgacggggaggacgtccgcgcgctcgacccggacctgctggccaggacggtcggcatggtcccgcagaagccgtacctgttctccgggaccgtcgcgtccaatctgcgctacgggcgcccggacgcgagcgacgaggaactgtggcgggcgctggaggtggcccaggcgaaggaattcgtctccgcgctggagggtggcctgcaggccccggtcagccagggcggcaccaacgtctccggcggccagcgccagcgtctggccatcgcccgcacgctcgtgcagcgcccggagatctacctcttcgacgactccttctcggccctggactacgcgacggacgcggcgctgcgcgcggcgctcgcccgcgagaccgaggacgcgaccgtggtcatcgtcgcccagcgggtctccacgatccgggacgccgaccggatcatcgtcctggacgagggtcaggtcgtgggtgagggacgccaccacgagctgatggccggcaacgagacctaccgggagatcgtgctctcccagctgacggaggcggaggccgcatgagcgggcccggaggacggatgatgatggggccggcccagcggtccatggacttcaagggctcgggcaagcggctgttgcggcagctcgcccacgaccgggccaagatctggggcatggtcgccgccgtcgtcggcagcgtcggctgtgcggtggtcggcccgaagatcctcggtgaggccaccgacctggtgttcgcggggatcgtcggccgcgagatgccggccggaaccaccaagcagcaggcgctggacggcctgcgggcccggggccaggacggtatggcggacatgctcgccggtaccgacttcaccccggggcagggcatcgacttcggcgccgtcggggtcgtcgcgatctgggccctggtggtcttcaccctggcgggcctgctgatgctggtcgccacgaggctgtcgaaccacgtcatgaacggcaccgtctaccggatgcgcgaggagctgcaggcgaagctgtcgcggctgccgctgtcgtacttcgaccagcagaagcgcggcgaggtgctgagccgggccacgaacgacatcgacaacatcggccagacgatccagcagacgatgggccagctgctgaactcgctgctgacgatcgtcggcgtgctcgtgatgatgttctggatctcgccgctgctggcgctggtcgcgctggtgacggtgccgctgtcggtcctcgtcgcggcgaagatcggcaagaagtcgcagccgcagttcgtggcgcagtggaagtcgaccggcgcgctcaacgcccacatcgaggagatgtactcggggcacaccctggtcaaggtcttcggccggcagaaggagtccgcggccgtcttcgccgagcagaacgaggcgctgtaccgggcctccttcaaggcgcagctggtcagcggcatcatgcagccggtgatgttcttcatctcgaacatcaactacgtgctgatagccgtcgtcggcgggctccgggtcgcctccggcaccctgtcgatcggtgacgtgcaggccttcatccagtactcgcggcagttctcgatgccgctgacgcaggtcgcctcgatggcgaacctcgtgcagtccggcgtcgcctcggcggagcgggtctacgagctgctggacgcggcggagcaggagccggacgccgaggttccggagcgcccggaggagctgcgcggtcaggtcaccttcgacaaggtgtccttccgctacgagccggacaagccgctgatcgacaacctctcgctcacggtcgagccgggccacacggtcgcgatcgtcggcccgaccggcgccggcaagaccacgctggtcaatctgctgatgcggttctacgaggtcacgggcggggaaatcgccctggacggggtggacatcgcgaagatgacccgcgaggaactgcgcaccggcatcggcatggtgctccaggacacctggctgttcggcggcaccatcgccgagaacatcgcctacggtgcttcgcgcgcggtcacgcgcgccgagatcgaggaggcggcgcgggccgcccacgccgaccggttcatccgcaccctgccggacggctacgacaccgtgctggacgacgagggcgcgggcgtcagcgcgggcgagaagcagctgatcaccatcgcccgggcgttcctgtcggagccggtgatcctggtgctcgacgaggcgacgagctcggtggacacccgtaccgaggtgctgatccagaaggcgatggcccgcctggcacgcggccgtacctccttcgtgatcgcgcaccggctctccacgatccgcgacgcggacgtgatcctggtgatggagagcggttcgatcgtggagcagggcacgcacgaggagctgctggcctcggacggcgcgtacgcgcggctgtacgcggcgcagttcgcgcaggcggtcgccgaggtcgactagcggtctcgttcgtgcgccgcagggcggacgggcaccaggggcacccgggtacggcacgtacccgggtgccccttcgccgtggttagcatgacggcatggcattggacgtggtgattcgccccgcccgggcggaggacgagcgcgagatagtggagctgttccgctcgacgtggtcgcgcgtgagtgaacccgggcccgagcgcccggccggcgcagccgtcttcgacgagcggcatcgcgtggagaactacctcgtcgcggaacgcgggcggaggatcgtcgggtacatcgcccaggctccggccagccccctcgaaaccaatcggcacgtccggcacatccagggactggccgtcctcggatccgcccgtggcggcggggtcgggcaggccctcgtcgaggcggtctgcgccgccgcgcgggccgctggtgcccgccgcatgaacctgcgggtgctcggccacaacctgccggcgcagcgcctctaccgacggtgcggattcgcggtggtcggcgtcctgcccgaggagttcctgctggacggggcctacgtcgacgacgtctggatgagccggagcctgaccggcccgcacgagcccgcgcagccgcagacgtagccgcagccgtagtcgcatccgcatccgccgccgagcgacggggcgggggcgcctggcggggcgccccctattccgtcggtccgtcagtccaggtagccgcggagctggtcggcgaaggcgtggtcgcgcagtttgttgagggtcttggactcgatctggcggatccgctcgcgcgtcacgccgaagatccggccgatctcctccagggtgcggggccgcccgtcggcgaggccgtaccgcagctgcacgaccttgcgctcgcgctcgccgagggtcgacaggacggcttccaggtgctcgcgcagcaggaagaaggcggccgactccacgggcgaggcggcgtccccgtcctcgatgaggtcgcccagcgcgacgtcgtcctcctcgcccacgggagcgtgcagggagaccggctcctgggcgaggcggagcacctccaggacccgctcgggggtcaactccaggtggacggccacctcttcggccgtgggctcgtacccgcgctcctggagcatgcggcgctgcacgcggacgacccggttgatcagctcgacgacgtggacgggcacgcggatggtccgggcctggtcggcgagggcccgggacatcgcctgccggatccaccaggtcgcgtaggtggagaacttgtacccgcgggcgtagtcgaacttctccacggcccggatcagtccgaggttcccctcctgcacgaggtcgagcatggtgagtccgcggccgacgtaccgcttggcgacggagacgacgagccgcaggttcgactcgatgagacggcgcttggccatccggcccatgacgacgagcttgtcgaggtcgagggcgagctgtgtgtcgaggtcgggggcggtgccgagcttctcctcggcgaagaggccggcttcgacgcggcgcgcgaggtccacctcctccgcggcggtgagcagcgggatcctgcctatctcgcgaaggtactgccggaacaggtcggcggacgggcccgccccgcctccgctgtcgctgctgctgcgcttgcgctgcgcgggcaccggctcgatcagctccagtacctcgggctcttcgtccacggccttggcctccgaggactcgctcacgttcacggtcagggtccgggtctgcacgggggcgacctccagggctccgaggacgggggcaccgaacctcagtgtggggtacgacacatcgcggccacgaggggcgtgcgagcactttctgagtccggtgcgtgaccggatggttaccccccgccgggaagcccgatgcggatcggacgcatgtccgagatgatcgactccatggcggagtacgcgctggcgcgcctcgacgcgtgggccggggcacgggagttgaaggtcacccacctcctgctggcccgcggccgcatggtgtcccagccgatgccgacgctgccggaccgcacgggccacgagcgcctggtaccccggctgcgcgcggccggcttcgacccggtccgggtcaaggtggagacggtcccgtggacgacggactcccccgggccgggcggcggttacttcgagcaccacctgaagctgctcctgccggcggggtacgagatccggtcgcaggagcgggagttcgtgctgtacgacagcggcccgtcggtggacgacgggtggatcgacgactaggccggctcgacgcggaccgcgcagactttgaattccggcatgcgggaggtggggtccagggccgggttggtgagggtgttggcgcggccctcgcccggccagtggaacggcatgaagacggtgtccgccctgatggtgtcggtgatgcgggccggggcgaccgcgcggccgcggcgggaggtcaccgcgagcgggctgccgtcgaccgcgccgatccgggcggccagccgcgggtggagttccacgaaggggccgggggcggccgcgttgagctcgtccacccggcgggtctgggctccggactggtactgggcgaccacccggccggtggtgagcagcagcgggtagtccgcgtcggggacctcggcggcgtcgcggtgggagacggggacgaagcgggcccggccgtcttcggtggcgaagcggtccaggaacaggcgcggggtgcccgcgtgggaggccccggagccttcgggatcttcggcgacgtcgacgtcggggcagggccagaagacgccctgttcggcctcgatccgggcgtaggtgatgcccgagtagtccgcggggccgccggccgaggcgcggcgcagttcctcgaagacctcctccggctccgtgggaaagcccttctcgacgcccaggcgggcggcgagtccgtgcaggacgtccaggtcgctgcggaccccgggcggtgcggacagggcccggcggcggagcaggacgcggccctccaggttggtggtggtgccggtctcctccgcccactgggtgaccgggaggaccacgtccgcgagtgccgccgtctcggagaggacgacgtcggcgaccgcgaggaagtccagggagcggatgcggtcctcgatgtgggcggcgccgggggcggagaccaccgggttcgagcccatcaggagcagggccttcacgtccgtgccgagggcgtcgaggagttcgtaggcgctgcggcccgggccggggagggcgtcggggtcgacgccccagaccccggcgacgtgggcgcgggccgccgggtcggtgagcttgcggtagccgggcagctggtcggccttctggccgtgctcgcggccgccctggccgttgccctgcccggtgaggcacccgtagccggagagcgggcggccggcccggccggtggccaggcacaggttgatccaggctccgacggtgtcggtgcccttggactgctgctcggggccccgggcggtgaggaccatggcggattccggagcgcagaacatcgccacggcctcgcggagcctggggaccggtatcccggtgatgcgctccaccagttccggccagtgggccatcgctgcggcccgggccccctcccagccggtggtgcgggcggcgatgaactccgcgtcggtccggccttccgcgacgatcaggtgcagcaggccgagcgcgagggcgaggtcggtgcccgggcgcggggcgaggtgcagatcggcctgttcggcggtgcgggtgcggcgcgggtcgatgacgatcagggtgccgccgttcgccttgagctcggtgaggtagcgcagggcgggcggcatggtctcggccaggttcgagccgacgaggatgacgcagccggtgcgggggatgtcctccagcgggaagggcagcccgcggtcgagcccgaaggcgcgctggtgggcggcggcggccgaggacatgcagaagcggccgttgtagtcgatttgcgaggtgcgcagggcgacgcgggcgaacttgccgagtgcgtaggccttctcgttggtgaggccgccgccgccgaagacgccgacggcgtccggaccgtacgcacggctcgtgcgggtgaggcccgcggcgacggcgtcgagggcctcctcccaggtggccggttccagccgcccggcgtgggtgcggacgagcggctcggtcaggcgcacccgggaggagagcacggcgggcgcggtgcggcccttgccgcacagtgcgccccggttgacggggaagtcggcgcgctcctccactgccacggtggcaccgcccggttcggggcggagcctcatcccgcactgcagggcgcagtaagggcagtgcgtgtcggtggcggagtccgaggtgtgcatacggctcagcctggggcggtggtgttacacgggccgccgtcccgcgttacaagcccgcatgctctgcctcagtgccgccccgcgcctgctgtgaggccgccggccggcccgtcggaccggtaccggcaggtccgggcggggtcgggtgcgtgccggggcgcccccgccgttccgctcgccggtccgggcgggtcaggcggtcaccggcccgtcaggtgcttcaccgtcaggcccgcggtccagccgccgtctacggcgagttcggcgcccgtgatgtagccggcggcgtcggagagcaggaaggcgacggcggcggcgatctcctcgggggcgccgacgcggccgagcggggcgccggggtagttgccctcgcccgcctggatgccgatcggggcggtcatcggggtcagggtcatgccggggtggacggagttgacgcggatcccggcctcggcgagctccaccgcgccgatcttcgacaggccgcgcacgccccacttggaggccccgtacccggcggtgagcgcgaggccggtgaggcccgcggcggaggagatgttgacgatcgagccgccgccgttggcgcgcagcagcgggatcgcggtcttgaggccgatgaacacgccgaccaggttgatctcgatgacctggcggaagtgctcgacgctctcgtgctccaggaaccggccggtggatatgcccgcgttgttcaccagcccgtcgatgcggccgaatgcggcgaccgcgtgctccagggccgtctgccagtcgtcctcgctggtcacgtcgtgccggaggaagcgcgccgcgccgccgagctgcgcggcggtctcggtgccctccgcctccagcacgtcggtgatcagtaccttgccgccgccgtccacgacggcctgcgcggccgcggcgcccaggccgcgggcccctccggtgatgacgacgaccttgccgctcagatccacaacagccacggttccccacccctgacgcgctcgtacggactgaccgacatatgactaatcggcataaccggcgccgcgtcagtctgccagagcggccagggcccgcgacaccccttcctccttcggtcccaggaagcgcggggcgggctcgaagaccgcgtccagcgccgccttgccggccgcgaagacctcgcgggtctcgccgtagtaccaggtggcgtcgtgcacgtcggccacgccgacgccgtacgactccaggcccgccgcctggcacagggcgacggcccggcggatgtggaagccctgggtgaccagcaccgcccgctccacgccgaagatctccttggcccgcacgcaggagtcccaggtgtcgaagcccgcgtagtcgctgacgatccgcgcgtccggcaccccgtgcgcggtgaggtacgtgcgcatcgcgtcgggctcgtcgtactccctgcggctgttgtccccggtgaccaggacgaccttgaccttgccggtgcggtacagctcggcggcggcgtcgagccggtcggccaggtagggggtgggccggctccccagcaggcccgcgccgaacaccacggccacctcggcggccggcgcgtcggccgtggtccgcagccggtcggccgccaccgcgtgcatccacgccgagggcagcagcgccaggacgcagcccgccatgacggcctgcaccgcccgccgccggttccgtacgctgcgcagcgccgccaccgcccggctccactcgactctcggcaggcgcggtcggcgcatcgtccatcccctggtgtctcggcagctcgtccgctggtcaggacgcgtaccggggccgtgcggttcacccggccccgatctccggcaggtgcgccgcggggcgcgccggcgccgaacagccccgccggacgccctgtgagcacacggcaaagacccgtcatccccgcgcaacgcaccggcaacctgcggcgcggaggatcgatgcatgacggagccggtgcaccctcccgaattccccgccctgcccttcgacagcacggccgagctcctcggccgcatcaccctccagctgggcacccagctcagcggcctgcgccgacccggagtccgcccatgcagcccaccctcgtcgccgtggcccacggcagccgtgacccgcgcgccctgcacaccgcccgcgccctcctcgaacgcgtccgcgaactccgcccccgcctcgacgtccggctcggccacatcgagctgaacgagccgctcctcgacgaaaccctgggcgggctctccggctcggccgtgctcgtcccgctgctgctcggccgcgggtaccacgtcaagcgcgatctcccggcggccgccgcccgggcccggcacctgctcacccgggtcgccgctccgctgggcccgcacccgctgctcgtcgaggccctgtacgagcggctcctggagaccggctggaccccggaccccggttcggccgtcgtgctggccgccgccggttcccgcgaccccgacgcggcggccgacacccgccgcaccgccgccctgctctccgaacgcctcggcggcaccccggtgacctgcgcctacgcctccgccgccgcaccgagcgcccccgaggcggtgcgcgccctcgccgcccgtggtcaccaccggatcgccgtggcctcgtacttcgccgctccgggccggttcgccgcccagaccgccgcggcggcgcccggccccgccgccgccccgctgggcgaccacccggccctggcccgcctgctgctgcaccgctacgacgaggcccgcgccctccccctggacctggcgcggccggaactcctctccgcctgatcccggtttgtcagttgttccggttaccgtctctgcatggaaggcaccacgcacgccctcaccgacgaccaccgcgacctctacgacgcggccgacaccgagcgctgggccgcggagcccgacaaacggcccggccggaccgccttccagcgcgaccgcgcccgtgtgctgcactccgccgcgctgcgccgcctcgccgggaagacccaggtcgtcacacccggcacccgttcctacgactgggacgcgagcccccggacccgcctgacgcactcgctggagtgcgcccaggtcgggcgggaactcggcgccgcgctcggctgcgaccccgacctcgtcgaagccgcctgcctctcccacgacatgggccatccgcctttcggccacaacggcgaggaggcgctcaacgagttcgccaaggactgcggcggcttcgagggcaacgcccagtcgctgcgcctgctgacccggctggagcccaagcggttcgtgcccgatccggcgagcggggagctcgtcagcgtcggcctcaacctcacccgggcctgcctggacgccgccaccaagtacccgtgggcgcgcggggaccaccccaccgaccccggctcggtgaagttcggcgcgtacgaggacgacctgccggtcttcgcctggctgcgccgcggcgcgcccgcggaccgcaagtgcttcgaggcccaggtcatggactgggcggacgacgtcgcgtactccgtgcacgacttcgaggacggcctgcacgccggccacctcgaccccaacctgctcttcgccgagcccgagcgcacggcgatctggcaggtggccatcggccggtacgtccccgccgacaccgcgcccgaggaactgcgggccgccctcgaccgtttgatggagcaggagtggtggccgcacgggtacgacggttcggccgtcgcccaggcccggctcaaggacgccacgagccagctgatcggccggttctgcctggccgccgagggagccacgcgggaggcgtacggctccggccgcctcacccgctacggggccgaactggtgatcccgcgcgaggcgcgcaacgagtgcgccgtactcaaggcggtcgccgacctgtacgtcatgcagcgcgacgagcaggaacggatccgcgccgaccagcgcatcgtcctggccgaactcgcggaggccctcagcgcccgcgcccccgaggggctggacccgcagttccgggcgatcttcgacgcggccccggacgacaaggccaggaagagggcggtcgtcgaccagatcgcgtgcctcacggacgctgccgcgcgttcccttcacgcacgcctcacccggcgcggccgacgcgccgaaaggtgaactgatcgagccactcccccttcacgcggcaggctcggtgcgggacgctcgcatgtggtcgcatgtggcggagaggttatgaggaggcatcaggtggtcgacgcacaccggacattcgtcatcgtcggcgcagggctcgccggggcaaaggcggccgaaacgctgaggtccgaggggttcacggggcgggtgatcctgatcggcgacgagcgcgaccatccctacgaacgcccgccgctgtccaagggctacctgaccggcaaggacgaccgggagagcgtcttcgtccacgagccgtcctggtacgcggccgccgacatcgagctgcacctcggccagcccgcggtccacctcgaccgggacgccaagaaggtggtcctcggcgacggagccgtcctgcactacgacaagctgctgctggccaccggcgccgagccgcgccgcctggaggtcccgggcaccggcctggccggggtgcaccacctgcggcgcctcgcacacgccgagcggctgaagggcgtactggccgggctcggccgggacaacgggcacctgctcatcgccggtgccgggtggatcgggctggaggtggccgccgcggcccgcggctacggcgccgaggtcaccgtggtcgaaccggaggccacgccgctgcacgcggtgctcggcccggagatcggccggctcttcgcggacctgcacgccgatcacggggtgcggttccacttcggggcgcggctgaccgagatcgtgggccacgacggcatggtgctggccgcccgtacggacgacggggaggagcacccggcgcacgcggtgctctccgcgatcggggcggccccgcggaccgcgctcgccgagaccgccgggctggcgctggtcgaccgggagcacggcggcgggatcgcggtcgactcctccctgcgcaccaacgatccggacatctacgcggtcggggacgtggccgccgcccaccacccggtcctcgggacccggctgcgggtcgagcactgggccaacgcgctgaacggcggcccggcggccgcgcgggccatgctgggccaggaggtcggctacgaccgggtgccgtacttcttctcggaccagtacgacgtgggcctggagtactcgggatacgccccgcccggcggctacgaccaggtgctgatccgcggtgacgcgggcaagcgggagttcatcgccttctggctgtcggagggccgggtcctggccggaatgaacgtgaacgtatgggatgtcaccgggcacatccaggccctgatcaggtcgaagacgccggtcagccgcgaggcactggcggacccgtcggttccgctggagtccctggtgcgggccgagggggcctgacggtttcgccggcgaccggccgtagacttcacgggtggcaggacggatcaatgacgacgacgtgaaggcggtacgggacgcggtcccgatcgacgccgtggtctccgagtacctccagctgcgcaacgcgggcggcggcaacctcaagggcctgtgccccttccacgacgagaagtccccctccttccaggtcagcccgagcaaggggctctaccactgcttcggctgccaggcgggcggggacaccctcgacttcgtcatgaagatcgaccacctgtccttctcggaggcggtcgagcgcctggccggcctggccgggatcaccctgcggtacgaggagggcggctacaccgccggcaccagcggccgcggtgaccgcatccggctggtcgaggcacaccgggccgcggcccagttctacgtcgaccagctggacagccccgaggcggagatcggccgcaagttcctggccgagcgcggcttcgaccaggccgcggccgcgcacttcagcgtgggctacagcccggccgggtgggaccacctgacccgcttcctgcgcggcaagggcttcaccgacaaggagctcatcacctccgggctcgcccaggacagccgcagcggcaagccgatcgaccggttccgcggccgtctgatgtggcccatccgcgacatcagcggcgaggtggtcggcttcggcgcgcgcaagctgcgcgacgacgacaacggcccgaagtacctgaacacgcccgagaccgcgatctacaagaagtcccaggtgctgtacggcatcgacctggccaagaaggagatcgcgaagacctcccgggccgtggtcgtcgagggctacaccgacgtgatggcctgccacatggccggggtcaccaccgcgatcgcgacctgtggcaccgccttcggcggggaccacatcaagatcctgcgccggctgctgatggacaacgccaccgccgaggtgatcttcaccttcgacggggacgcggccgggcagaaggccgcgctgcgggccttcgaggacgaccagaagttcgccgcggagacctcgatcaccatcgcccccggcggcatggacccctgcgacctgcgcctcgcacagggcgacgcggccgtgtccggcctggtggaggcccgcacgccgctgttcgagttcgcgctgcggcacatcgtggcccggcacaacctggagaacccggcgggccgggcggccgccctggacgaggccgctcccgtcgtcgccaacatcaagaacatcgcgatccagcacgagtcggccgtccagctggcgggcatgctgggcatccgcgacgagcagttcgtggtcaagcgggtcgcgcagctggcccgctgggcccgcgagcgcggccagggcgacggaccccagggcggccggccgggcgggaagccgcagcgcggccgcccgtcctacgaggacgtccccgcccccgccgcccagccggccggcggccccgcgctgaacctgcgcagtccggcccaccgcaccgagcgcgagctgctgaagctcgccctccagcggcccgccctggtctccccgaccttcgacgcgtacggcatggacgagttcaccgccccgccctacgcggccgtgcgccaggcgatcctggacgcgggcggtgcctcgctcggcgcggaggactacctggcccgcgtccgcgcggccgccccgaacgacaccgtgcgctcgctcgtcacggagctggcggtcgaggccatccacgcgaagacggtggacgagatgtacgcgggggtccagctggtccaggtgcggctgcgcgccgtcgaccgccgggtccacgagatccagggcacgctgtcgcggctgggcccgcaggccccgccggaacaactggccgccgtccaggaggagctgtgggtgctccagcagtacggccagcggctgcgcaaccgcggcgcggagggtctgtagccgcggctcagtggcgcgcgaaccagtcgccgccggggatctcccggcctgattcccgcaggtcacgggctatcagcggggccgccagatagacccaggcgcgcaccgtggtgccgtcggggcgcagggccgggcgggcgatccggtcgtacatgttccccgggaggcccgggcccccgtactcctccagccggtccagcgcggccagcagcctcccgtacgcgcccggcgccgccgtgatcagctcgccgaccaccgccgtgccggggcggtggaccgcgtacgggtagccggggccgtcgtagagcgccgcgtccgggaggacggccggctcctccgaggccgtgcggccgcgcaggaagaggtcgtggttgacctcgcccgggcgcagggtcccgtagacgaagaacgggagcggatcgctcgggtccggtagccgttcgaccgatgtcacggggcctccctgggatgtggcgcggcggtacgcgggccgggccgcgagccccggccctcccgcgctccaccaccgtacgcaccgctggtgcacggcctcgcgggcggtcggcgtcacccggacggcgcgggacgctccgatggccgcggcacatgtgttgacctgcgtggacgttccgcgggcggggtacgggaaggcgtacctgacgggacatcagcaggcgcctggcgggcggtccgggtttcctcggaaacacgaccccgtgtctccaggagagtccccatgcgccgacgtaccgcacacctgctgaccgcgaccgcgctgaccgccgccgcgttcaccgggccggtcgccggcgcgatggccgccgcggacctcggcgtggtgggcttcgcacccggggacttcgcagcgctggaggtgtggcccaagtccgcggccccgggtgccaccgtcaccgtgaacaccaccgcctgcggcagcggcagccacgcggacggcgatgccaccacggtcggcggcggccggttcaagctggtcccgggcacccacaaggaggtggtcgtggggcagttccagatcgcccacggcacccgtggcggcacctacggcatcggcgcgacctgcgcgaacggcaagttcgccaccggcaatctgaccgtcaccgagcgcggcccgcagggccacgtcaacaccggggtgggcggtggcacgaccaccaccaccgaccccgccaagatcgcggcgggggtggccgtactggccgctgccgccgtcggcggtacctggctcctgcgtcgccgggcgagcggcacgcggagctgacggacgcccaccgcggctccggccgcggtccgaccggtaccgtcccccgtcgcccgccccgcgaggtcccccccgttcgcggggccgggcgacggccactcaccccggaacgaagcggagggggtacgcatgggtggcgattccggtggcgagcggggccgtgacctgtggccccggcccaccgacggcgaccgccccggttccggagcgcgccccgggcgggcggggaaccgggccgtccgcacccccaccgcccgtcacggcggactcgtcgcgctcgccgcctgcgtcggcatctggctcgtgaccagcggttcacgcgaacccgtcggaccgccgctgccctcccccgccgagtcgctgaccgccgccggcgtggtgggccctggtatcgccccgctccccggttccccgccggcccggatccggatcccctccatccgggtcgacgccccgctgaccggactcggactcgacgcgcgcggcagcctcgaagtaccgccgcccgaccggcgggacctggccggctggtaccgcgacggcaccaccccgggcgccaccggcaccgccgtcatcgccgggcacgtggacgacgccgccgggccgggggtcttctaccacctgggcgcgctgcgccgcggggcctccatcgaggtcccgcgcgcggacggccgtacggcggtgttcacggtccacgcggtggaggtgtacgacgccaaggccttccccgacacccgcgtgtacgggccttcggcgcgcgccgagctgcgcgtgatcacctgcggcggcggcttctcgccgcgcacgggctaccgcggcaacgtggtcgtcttcgcgcacctcaccgggacgtactagggggtgtctccgggcgggtcagccccactgttcgaagccgagcttgagcaccagcgcgcccaccaccgtcagcagcacgccgcggacgaagccgctgcccttcttgagcgccataccggcaccgatcatgccgccggccaggttgaacaccgccatcagcgcggccagctgccacagcaccatgccctggtaggcgaacatcgcgagcgctccggcgttggtgcagcagttcacgatcttggcggtggcggatgcggtgaccaggtcgaggtggagcagagccgtgagggcgagcaccaggaaggtgccggtgccgggcccgatgaggccgtcgtagaagccgatgccgaggcccgcgagcccgatggcgagcagcacccgctgccggctgacgggcgcggccgacggggcggtgccgaagcccggcttgaagatcacgacgcccgcgacgatcacgagcaccaccatgatcagcggccggagcgcgtccttgctgatgccgcccgcgagcgcggcaccgcccatcgagccggcgagcgcggccaggccgatgcggacggccagcttcacgttcaccggggccttccgggcgtacgtgacggccgccccggcggtgccgacgatggccacggccttgttggtaccgaggacggtggcggggtgggcgttcggcaggccgaggaggagcgcgggcaggagcagcaggccgccgccgcccaccaccgcgtcgatccagccggccgcggccgcggccacgcacaggacgatgatcatggtcgttgatatgtcaggcacggcacgaccctatggaccagttgggtgcagtgaccatcaatccccggaaagttgcgcaaaggttgaggttcggccggccggcacgcggtccggggccaccggagccgccgggtccacggcccccgtcagcacggtcgcggccagcacactggccgcccccagccccgccgccagccgccgcgcgggcggtacgcgggccagcacggcgagcccggcccgtaccggcgaggggcgccgcggcttgcggtgccgggccccggccgccgcgaccgccggagcctcggcgccgacgggtacggagagggcgacgtgcagcgggtgacgcatgggccggtgactcctcggggaacgcggaacgcggggaaggcaggaaaggcaggggacgcggagacgcggggacgcggctcagaagctgaagcactcggaatggatacggccggccggcaccccggcccgcagcagcgctgcccgggtcgcctcggccatccccggcggcccgcacaggtacacgtcgtgctcggccaggtccgggaccagcgcggccagcgcctgcggggccagcggatcgtaggcggcgtcggacggcccgagcagatagtgcagaccggcctgccgctcggcggcgatggcctccagctcggtccgcagcacgaggtgctcctcggccccggcccggtagagcagggtgatgtcccccgggcccccgggcagcgtctcgaacagggcccgcatcggggtgatcccgaccccgcccgcgatcagcagcaccttgggccgggtccgccgggcggcggtgagcgcgccgaacggcccggtggccagcacccgcgtcccggggcgcagccggcggatccggcgggagtggccgccgagccccttcacggtgatccgcagggcgttgccccggaccggcgcggacagcgagaacggcagggccgtgtgccacagccgccgctggaggaaccgccagcgcaggaactggcccggctccgcgcgcagttccgccaggtgctgcccgtacatgacgacggagaccaccccgggcccctcgacccggacgtccgcgacccgcagcgcgtgccgcatggcctgccggacgggcacgacggcccggtaccagaccagcaggacggcgaccacggtgtgggccagcgcccagaaccaggcggccgcggccagatcgggcccggcgagctggtgcccgaaggcgagggcggcggcgaggtagacgagcaggtgcacccctcgccaggtttcgtgcggcacccggcggcgtaccgcccgggcggaggtcacgccgaccgcggccaggaggacggtcccggccacggcggcggcgagcgcggggtaaccgagcagctccgaggcggcggagaccacgtcggttccctcgtgcacggcgtatccgagcagggcgaagagcccgtgcccgaagacgagcagcaggacgtaccggccgccgaaggcgtgccagcgggcgagccggtcggcaccgaccccgtgctcgacggcgggtacccgggccatcaggaacagcagcaccagcaccccgtagccggcgagcagtccggacaggtgcgcggcggtggcgaacagcgcgtccgggcgggccgagggccgtacctgcgccgcccagagcagggtcaccacccccgcaccggccagtatcccgcccctcacccgccccaccgcattccgcatacggatcacgctaaggccgcaggtggcggccctgatgacccttaaggcggccttgaggaaggcctcaccgacccttaacccgggcgctgaggtcggcgttccgtccgggtaacagaggcgatgtcgtggggaaacagcggccgcgcacgctcatggcatgacctcggaacagcgtgtggtggtgatcggcggcggcctcgcgggcctgcggctcgcgcagcggctcggcccggccgcggcggtgaccgtcctcggcgaggagacccatgagccgtacaaccgggtcctgctcgccgagatcctcgcgggccggtacgcgccggaggtgaccgccctcccggcgcccggcccggcgctgcggcgcggggtccgggcggtccgcgtggaccgtgcggagcgggccgtgcactgcgacgacggcacggtggagcggtacgacacgctggtgctggccaccggctcgaacgcggtgctcccgccgctgcgcgggctgttcgagcccgaggggcgggaactcccggacggcgtgcacgccttccgcacgatggacgactgcctggcgctctcggcggccgtacgccccggggtccgcgtggtggtgatcggcgggggcctgctgggcgtctcggcggcccgggcgctcgccgtgcgcggcacgcaggtggtcctggcgcagcagggcgagcgcctgatggagcgccaactggacgcggaggcctccgccctgctggccacgcacctgaccgacctcggagtggagatccacacggaatgccgggtccgcggcctggggacggcgcgtccggcccctgcggcgtgtgaggagcggggtccggggcgcagccccggcagcggcgccgcgcaggggcatcgcaaggtcacgggggtcgagctcgccgacggctaccggctcgacgccgacctcgtcgtcctcgcctgcggcgtacgcccccgcaccggcctcgcccgggccgccgggctggaggtccgcaagggcatcgtggtcgacgaccggctccgtaccggcgacccgcacatccacgcgatcggcgactgcgccgagcacgccggccaggtgtacggcctcgcgggccccgccctggaccaggccgacaccctggccgccttcctcaccggcgagcccacgcagtacaccggcacccgcgccctcacccgcctcaccctcgacaccggcgagggcaccggcgggaacgggcccctcgacctcgccgccttcggcgagaccacccccctgcccggcgacgacgtggtccgcctcgccgacgccacccgccgcacctaccgcaaggtcgtcctgcggggcgaccgcctcgtcggcggcgtgctgctcggcgagctctccaccgtgggggccctcgcccgcacctgggagggcgaggaatcaccgcgcgacctgttccacctgctcaccgacgacggaggccactgacatgaccgagcccttgcccacgatcgtgctcatcgggcacggcatggtcggccagcgctacctcgaagcactcgccgagcgcggggtcaccgccacgcaccggatcaccgtgctctgcgaggagccccggcccgcctacgaccgcgtgcacctgacctcgtacttctccggcagcacgcccgaggacctgtccatgacgcccgtcgggttcatggagcagcacggcatcgccctgcacctcgacgaccccgccgagcacatcgaccgggccgcccgtaccgtcacctcccggtccgggcaggtgttcccgtacgacgtcctggtgctggccaccggcagctaccccttcgtgccgccggtcccgggcaaggacgcccccggctgcttcgtctaccggacgatcgaggacctgctcgcgatcgaggagtacgccaagagccgcagctgcggcgcggtcgtcggcggcggcctgctcggcctggaggccgccggcgccctccaggggctgggcctggccacccgtatcgtcgaattcgcgccgcgtctgatgcccgtacaggtcgacgagggcggcggcgcggccctgctgcgcaccatcgagtccatggggctgaccgtccacaccggtgtcggcacccaggaagtggtggtcggcgaggacggccacgtcagcggaatgcggctttccgacggctccaccgtcgacaccgacctcgtcgtcttctccgccggtgtccgcccccgcgaccagctggcccgcgacgcgggcctggacgtcggcgagcgcggcggcatcgcggtcgacgcccgctgccgcacctccgacgcgcacgtgtacgccatcggcgagtgcgccctcgccgtcgacgggcgggtctacgggctggtcgcccccggctacgagatggccgagacggccgccgacgacctgctgggccgcgagaaggagttcaccggggccgacctctccaccaagctcaagctgctcggcgtggacgtggcctccttcggcgacgcccacggcgccaccccggacagcctcgacgtcgtctggtccgactcccgctccggggtctacaagaagctggtcgtctcccccgacggcgtcctcctcggcggggtgctcgtcggcgacgcggactcctacggcctgctgcgcccgctcaccggcagcgttccgcccgtggctcccgagcagctggtactgcccgccggggtcggcgcaccggtcgcgctcggcccgtccgcgctccccgacgacgcggtgatctgctcctgccacaacgtcaccaagaaggccatcgccgcctgcgccaccctccccgaggtcaagaagtgcaccaaggcgggcaccggctgcggcagctgcgtcaaggtgatcggccagctgctgcccgccgcgaccgacaagggactgtgcggctgcttccccttcacccgggcagagctctacgagatcgtccgcacccgccggctgacctcgtacgaggagatcctcgacggccacggccgcccggaggcccgcggcggcgacggctgcgaggtctgcaagcccaccgtcggctcgatcatcgcctccctcgccccgaccctcggcgcgagcggctacgtcctggacggagggcaggccgccctccaggacaccaacgaccacttcctcgcgaacatgcagcgcaacggctcctactcggtcgtcccgcgcatccccggcggggagatcacccccgacaagctgatcgtgatcggcgaggtggcccgggacttcggcctctacacgaagatcaccggcggtcagcggatcgacctcttcggcgcgagcgtggaccagctcccgcggatctgggcccggctcgtggaggccgggttcgagtccgggcacgcctacgggaaggccctgcgcacggtgaagtcctgcgtgggacagacctggtgccgctacggggtccaggacagcgtccggatggccatcgacctggagctgcgctaccggggactgcgctccccgcacaagctcaagtcggcggtgtccggctgtgcccgcgagtgcgcggaggcgcagagcaaggacttcggcgtcatcgcgaccgcgagtggctggaacctgtacgtgggcggcaacggcggggccaccccgcgccacgcggacctgctggcccaggacctgtcggacgcggaactggtccggctgatcgaccggttcctgatgttctacatccgcaccgccgaccggctggagcggacctccacctggctggagcggctggagggaggcctggcccacctgcgggacgtggtcgtgcacgactcgctcgggctgtgcgcggagctggaggccctgatggccgaccacgtggcgcactaccgggacgagtgggccgagacgctccaggacccggagcggctgcgccggttcgtgtccttcgtcaacgcgccgggcgccccggacccgaccgtgaagttcgtccccgagcgcgaccaggtcaagcccgacctggccgtcctgaccataggaggacccgtccgatgaccgtggaactgaaggtggcgcagggctggctgacggtgtgcgagctgtccgcgctcatccccgggcgcggggtggcggcgctgctgccggacgggagccaggccgcggtgttcgtcgaccgcgcggggcgcccgtacgccatcggcaaccaggaccccttcaccggggcgcaggtgctctcgcgcgggctggtggggacggcggggggccggcccttcgtggcctccccgctgctgaagcagcgtttcgacctggagtcggggcgctgcctggacgacgaggagacggcggtgcggacctacccggtacggaccgccgtgacctcgtgaccgcgtgacctcgtgaccgcggggtgggagcgtgatcagccctggaccaccgacgggtccatccacatgatctcccaggtgtgaccgtcgaggtcgtcgaaggcacggccgtacatgacgctgtggtcctgggcggggcggggctcggtggcgccggccgccagggccccgtccaccagctcgtcgaccgcggtgcggctctcggcgctcaggcagagcagcacctcggacgtcttcgtcgcgtccgcgatctccttgtgggtgaagtccttgtagcgggcctccgtcaggagcatcgcgacgatggtgtcgctgatgaccatcgaggcgcagttctcgtcggtgaactgggcgttgaaggagtagcccagcttgctccagaacgccttgctggcgtccaggtccttgaccggcaggttgacgaagatcatggtggcggacatccgaggtctcttctctcgtaggtggttcccggtgcttcccggtgttttcgagaggtagaccacggggcccccggaaactcatcgctcggcgcgaagttttctcgaactttctttcctgacctacgaaaccgcaggtcagaccgctgagctcgccgaggtcggcgatccgcggaaggcgggcctccaggtccacgtcgagcggtcgcccgtgcgtcatgaggagttggcgccaccgcaacggacgtctcctaggttcctcgacgcgtgcgacccgcgtccgaccggccgcggggccttcctcccacaggagtgaccgtggaacgtcgtaccttcctgcgcggcgcagtgatcggttcgtcggccgccgccttcggcggcacgttgatgcacggggccgcctatgccgcccccgcccagccgggcgccggaccgtacggtgcgctcggcgcggccgacgccaacggcatcatgctccccagcggcttcaccagccgggtcgtcgcccgctcgggccagaccgtcggcggcacctcgtacagctggcacagcgccccggacggcggcgcgtgttacgccgacggctcgggctggatctacgtgtccaactcggagatcaacccctccggcggggcgagcgcggtgaagttcgactcctccggcaccatcaccggcgcctaccggatcctctccagcacccggcagaactgcgcgggcggcaagaccccctggaacacctggctgtcctgcgaggaggtcgaccgcggcttcgtctacgagaccgacccgtacggggtgaacgcggccgtgcagcgcccggcgatgggccggttcaagcacgaggcggccgccgccgacccggtgcgccaggtgatctacctgaccgaggacgagaccagcggctgcttctaccggttcatcccggccacctggggcaacctctcctccggcaccctccaggtcctcaaggccggaaccgccacctccggctccttcacctggcagaacgtcccggacccggacggctcgccgaccgcgacccgcagccaggtctcgggctcgaagaagttcaacggcggcgagggctgccactacgccaacgacaccgtctggttcaccaccaagggcgacaaccgggtctggcagctgaacctcgcgaacagcacgtacgagctggcctacgacgactcgctcgtgcccggcggcgcggccccgctgaccggcgtcgacaacgtcaccggatcgtcgtacggcgacctgtacatcgccgaggacggcggcaacatggagatctgcctgatcaccccggacgacgtggtggcgcccttcctgcggatcaccggccagtcctcctccgagatcaccggcccggccttctcccccgccggcaaccggctctacttctccagccagcgcggcacgagcggcagctcgtccggcggcatcacctacgaggtcacgggccccttccgcacctgacccccgctcttccggccccgccggcgctcccctccagccccgccggcgtttgaggcgcgggggccgggggggcggcgcccccctattccagccccgccggcgtttgaggcgcgggggcccgggggcagcgcccccgcaacggaccggcacccgcacgaccggccgcaccccgacgggtacgaaccccgccggggtacggccgcgtcacgaggccacggccccacccctcagcagcgcggcccccagcggcgtcacggtgtgcagcaccgcgttcccccgccgcagcgtggtcaccagccccgcctcccgcatcacgcacgcgtgctggctcgcggaggccagcgagaccccggcccggcgggccagctcgctggtggtcgccccgtcccctatggcccgcagcaccaccgacctcgtgtgccccaccagcttgcccagcgtgcgctggcgctgctcctccacgggccgcgccgactcgcctcccgccggcgccgaggccagctgcgccgccgccggatagaccagcaccggcggcagctccggatcgtgcagggtcaccgccgtgcgccggcagaagaaggacggctggagcagcagcccgcgcccccgcagccgtacgtcacggtccaccggatagtcgcactccagtaccggagcccgccagcgcagcatgggcgggagcgagtccagcagttcgtccgcgcccccgtccagcagggcccggccgcgcgcggcgcgctcggcttcgatctgggcctggatatgcgtccagtagggctccacggcggcccggtggtacgcgcggagttcgcccatgagccgcggcagctgtttgtcaccgccgtccatgaactcccgtagccgcggcggcatcggcgcgccggcacccagcagctgcagctcgcgccgcatgcgctcgggacggatcccgcgcagcgcgtcgaggcccacgtcccacccgtactgcccctccacaggggtcaagaaatcggggaaataaccacgactcggtatgagcataccgagcgtgcgtgtttcactattcaacctgctccgggtttccgtacgccattcaccgaacaaccgggcatcgcgccggtctcttaagcggtgaaagctgagaatcgtttcccacaacgcatcgggacgccctgccatccgtacgcgtgccaggtccactccagtgaaatggatacgcagcaccgaacccccacctgtgcaaccgcaatccccccgccccatgagtatgcacgccgtcacacgttgtcaccacgccctttcggccacagttgaaacccctttcggcgggggcgtgacaaccgaaatcctgtactccgccgggcacactccggtgcgaccgaaacgctccgcgaaggccgtggggggctttgcggggcctggcggtcggtcgcaccgggaagcgccgacgtgcccggcagaatgacagcggcggtggacgggtggggatccgtccaccgcctgctggcgtaaagatttgttgaacaacaaaaataggcgcgcccgcccccgggcagtcagggaacccggggacaggcgcggtctatggggcccatggcgggccaggggtcagcggctgtcgctgcccttcgcctcggcggccgcacggccggcctcaagacgcgccaccggaatccggaagggcgagcaggagacgtagtcgaggccgacctcgtggaagaagtggaccgactcggggtcgccgccgtgctcgccgcagacgccgagcttgaggtcggggcgggtggcccggccctgctcgaccgcgtggcgcacgagggagccgacgccgtccttgtcgatggtctcgaagggcgagaccccgaagatgcccttctccaggtaggcggtgaagaagctggcctcgacgtcgtcgcgggagaagccccacaccgtctgggtcaggtcgttcgtgccgaaggagaagaactgcgcggcctcggcgatctgggcggccgtcagggcggcgcgcggcagctcgatcatggtgccgatggagagcttgagggtggtgccggtggcggcctcgacctcggcgatgacctggtcggcctcctcgcggacgatctccagctcctggacggtgcccacgagcgggatcatgatctcgacgcgggggtcgcccttggcgttcttgcgctcggccgcggcctcggcgatcgcccggacctgcatggcgaacaggccggggatgaccaggcccaggcggacaccgcgcagacccagcatcgggttctgctcgtgcagcttgtggacggcctggagcaggcgcaggtcgttctcgttggcgtccttgcgggactcggcgagggcgacacggaccgacagctcggtgatgtcgggcaggaactcgtgcagcggcgggtcgagcaggcggacggtgacgggcaggccgtccatcgcctcgaacagctcgatgaagtccttcttctgcagcggcaggagggcactgagtgcctgctcgcgctcgccgtcggtgtcggcgaggatcaggcgctcgaccatctcgcggcgctcaccgaggaacatgtgctcggtgcggcacaggccgatgccctgggcgccgaagcggcgggcacgcagcgcgtcctcggcgttgtcggcgttggcgcgcacccgcaggcggcggacgcggtccgcgtaggccatgatccggtgcacggcggcgacgagctcgtcggcgtcgtcggcgccggcgtgcatgcggccctcgaagtactcgacgaccggggacggtacgacgggtacctcaccgaggtagaccttgccggtggagccgtcgatggagacgacgtcgccctcttcgatgaccgtctcgccgaccgtcatgcggcggcgcttggtgtcgacgtcgagctcctcggcgccgcagacacaggtcttgcccatgccgcgggcgacgacggcggcgtgcgaggtcttgccgccgcgcgaggtcaggattccctcggaggcgatcatgccgtccaggtcgtccgggttggtctcgcggcggatcaggatgaccttctcgccggagcgggaccacttgacggccgtgtacgagtcgaagacggccttgccgaccgccgcgcccggggaggcggcgatgccgcggccgagcagggtggtcttcgcgccctcgtcgaagcgcgggaacatcagctgcgcgagctggtggccgctgacccgctggagggcctcggcctcgtcgatcaggccctggtccacgagctgggtggcgatgcggaaggcggcgccggcggtgcgcttgccgacgcgggtctggagcatccacagctggccgcgctcgatggtgaactcgatgtcgcagagatccttgtagtgggtctccagcgtcgtcatgatcgtcatgagctggtcgtaggaggccttgtcgatggtctccaggtccgcgagcggcacggtgttgcggatacccgcgacgacgtcctcgccctgggcgttctgcaggtagtcgccgtagacgcccgcgtggccgctggcggggtcgcgggtgaaggcgacgccggtgccggagtcggggccgaggttgccgaacaccatggagcagatgttgaccgcggtgcccaggtcgctcgggatgcgctcctggcggcggtagagcttggcgcggtcggtgttccacgagttgaagacggcctcgacggcgaggtcgagctgctcgcgggcgtcctgcgggaactcgcggccggcctggttggcgacgatcttcttgaagcgggtgaccagcttcttcaggtcggcggcgtcgaggtcggtgtcgacggtgaccttcttggcggccttggcctcgtcgagggcgtcctcgaagagctcgccgtcgacgtccagcacggtcttgccgaacatctggatgaggcggcggtacgagtcccacgcgaagcgctcgttaccggcctgggaggcaaggccggtcacggactcgtcggagaggccgatgttcaggacggtgtccatcatgccgggcatcgagaacttcgcaccggagcgcacggagaccagcagcgggtcgtccgactgaccgagcttcttgcccatcttggcttcgagggcggcaaggtgggcgctgacctcttcgcgcagggccgccggggccgagccgctgtcgaggtagaccttgcaggcctcggtggtgatggtgaagccgggagggaccggcagacccaggttggtcatctcggcgaggttggctcccttgccgccgagaaggtccttgaggtcgcggttgccctcggtgaagtcgtagacgaacttctgatctttgttttccgacacgggtctcgactcctcgaggctcggtggctgccctgacggccaggaacatacccagatcgaaggcttctgggtacgtccacttggtcgtcatacggccgtaaccacccgtgcgccagcagatcgaaagtaactcatgggtaatcagaaagccgccggagcgttcacatcccgaagggtgagggggctcctgaggcctgatcacgctcggatgagcgatcatcgatacatttgccttcaagtattgaacgcacaaagggtggcacccagtgccaccctttgaaagtcttacccgtgacttctgcgctcatctgagcgaaacccttcccatgcgtggcgtatatcacgcaccacggagggcgatttgtcagcctccagaggtgtccagttcggcgtcctcgctcacaccggcgcagtcgtacgggtccttcagccagccgtccggcaggacaactcggttgtttccggacgtccgaccgcgaggcccgtccgcactctcgggccatgcttgatccagatcgagctcgctcagatgagcgttgagctcggccagcgacgaggtgaccgcgagcttctggcgcatcccggagcccaccgagaagcccttgaggtaccaggccacgtgcttacggaagtcgatcaccccgcgcgcctcgtcgccgatccactcccccagcagctgtgcgtggcggtgcatggtcgtcgccacctcgcgcagggtgggcttgtggaagtcctcggggcgcccctcgaaggccgccaccaggtcgttgaacagccacggccgccccaggcagccgcgccccacgaccacgccgtcgcagccggtctcgcggaccatgcgcagcgcgtcctcggcgcaccagatgtcgccgttgccgaggacggggatctccggcacgtgctccttgagccgcgcgatggcgtcccagtcggcggtgccgccgtagtgctgcgcggtggtgcgcccgtgcagggctatggcggtgacgccctcctcgacggcgatgcggcccgcgtcgaggtaggtgaggtggtcgtcgttgatgcccttgcgcatcttcatggtgaccggcaggtcaccggctccggcgacggcctcgcgcaggatggcgcgcagcaggttgcgcttgtacggcagggccgagccgccgcccttgcgggtcaccttggggaccgggcagccgaagttcaggtcgatgtggtcggcgcggtcctcttcgacgatcatgcggaccgccttgccgacggtggccgggtccaccccgtacagctgaatcgagcgaggcttctcggtctcgtcgaagtggatcagctgcatggtcttctcgttgcgctcgaccagggcgcgggtcgtgatcatctcgctcacgaacagccccttgccgcccgagaactcccggcagagggtacggaacggggcattggtgatgccggccatgggtgcgagcaccaccgggggctgcacggtgtgcgggccgatcgcgagaggcggggggagcgtggtcatccgcccattgtcccgcatgccgagggggtgggggagacgtagcatcggcgcatgatcgagtcgagtccccggcagcgcatgctcgtcctcgcgatctgctgcatgagcctgctgatcgtcagcctcgacaacaccgtgctcaacgtcgcgctgccctcgatgcgccgggacctggacgcctcggtctcggggctgcagtggagcatcgacgcctacaccctcgtgctggcctcgctgctgatgctcgcgggctccacggccgaccggatcgggcgccggaaggtgttcgtggccggtctggtggcattcacgggcggctccctgctctgctcgctcgcccccagcctcaactggctcatcgtcttccggatggtccaggcggtcggcggcgcgatgctcaacccggtggcgatgtcgatcatcaccaacaccttcaccgatcccgcggagcgggcccgggccatcggtgtgtggggagcggtcgggggcgtctccatggcggcgggccccctgatcggcggggtgctggtggactccgtgggctggcgctcgatcttcctgatcaatctgccgatcggtgtggcggcgttcgcgctgaccctgcggcacatccaggagtcccgggcggcccggccgcgccgcccggacccgctggggcaggtgctggtcatcgccctgctggggagcctgacgtacgggatcatcgaggcgccggccgcagggtggcgttcgccgctgatcatggggtgcgcggtggtggccttcgccgcgttcgtggggctgctgatccacgagccccggtgcaaggagccgctgatcgacctccggttcttccggagcgcgcccttcagcggatcgacggtgatcgcgatcagcgccttcgccgggctggccgggttcctcttcctgaacacgctgtacctccaggacgtacgggggctcagcgccctgcacgccgggctctacatgctgccgatggccggcctgaccgtcctgttcgcgccgctggccgggcggctggtgggcagccgggggccgcggatctgcctgctgatcgcgggtgtggcgatggcgtcgagcgggttgctgttcgccctgttcgaggccgagacgtccaatccgctcctgttcaccgggtacatgctgttcgggctgggcttcggcatggtgaacgcgccgatcaccaatacggcggtgtccgggatgccgcgctcccaggccggggtcgcggccgccatcgcctccaccagccggcagaccggcggcaccctgggcgtcgcggtgatcggctcggtgctggcggccgggctggcgaacggctcggacttctccggggcggcccagccggcctggtggatcatcacgatctgcgggctgctcgtcctggtcgtgggcgcggcgacgagcggtgcgtgggctcgcgggacggcggagcggaccgcccgcacgctggaggaggcagtcggcacggcgtcgacgacgacggggtcgccgcgcgggtaggccgtccggaggcgtccgagggggcgggccgtccgctccccgcgttcctgtcggctactcgccgcaggcgaagtcctcggccgaggtgttgacccggtcgaggaggccgcgcaggagctcgcgctcggcggccgacaggcccgcgaagatgccgctctcgacctcgtcgagggcggtgttcgtcttgtggagggccgcgtcaccggcgtcggtgatggccacgttgtggcggcggcggtcggccgggtcccggcggcgttcggccaggccctcgccctccaggtcgttcaggatcccgacgagcacgctcgggtccacctccagccgctcggcgagcgcccgctggctgatgggtccgccctccaggtgcatcagtgccatcgcgtgccgcggggtgagcccggccgtgccgagtgcccgtttcatccgcgtctgggtgaccgatccgtgccaggccagcagcaggcccagccgctgcggagggtgcggtccgtcctggtctgccgtcatggtccacatcgtaacaaccaggaaatgattgcactgaacggatcgttgatgctattcaatggtttcacatcgtcgaccgttggagattttcatgttcctcgcctacgccgtcgtcggaggcctgctcgccctcgtcctcgccgcctccgccaccttcaccctccagcgcaacgagcaggtcgtcgccggcatccggaaggtccaggtgccggactcgtggctgccggggctcgccgcactgaaggccgcgggcgcgctcggcctggtcgccggcctgtgggtcactccgctcggcgtggccgcggcagtcggcgtgaccctctacttcgtcggcgctgtcatcagccacctccgggtcaaggactacgagctggcaccggcggccgtcctcgccctggtcgcggcggccgccctggcgctgcggatcctcgcctgacactgacgagtgacagatattgaaatctgtcactcgtcatgccattctcgtcttatgacgacgaacgagagcacccacccgaccgccggccgccgcactctcggcagcaccggccccaccgtcttcccgctggggctgggctgcatggggatgtccgccctctacggggaggcggaccgcgccgagtccatcgcgaccattcacgcctatctggacgccgcccccgacggcacgcacacgctgttggacaccggcgacttctacggcatggggcacaacgaactgctgatcaacgaggccctgcgcacggcgcccgcggaagcccgcgagcgggcgctgaccagcgtcaagttcggtgcgctgcgcacggtcgagggcggcttcaccggttacgacggccggccggaggccgtcaggaacttcctggcctactcgctccagcggctcggccgggaccacatcgacatctaccggatcgcccgcgtggacccggacgtaccgatcgaggagaccgtcggggccatcgccgaggcggtcgaggccgggcacgtgcgccacatcggcctctcggaggtcggtgcggacaccctgcgccgggccgccgccgtggccccgatctccgacctccagatcgagtactcgctgatctcccgcggcatcgaggccgagatcctgccggccgcccgcgagctcggcatcgggatcacggcgtacggggtgctgtcccgcggcctgatcagcggccacttcacccgcgaccgcgcgctggccccgggcgacttccgcggcatgagcccccgcttccagggcgacaacctcgaccggaacctcgacctggtggaggcgctgcgcaaggtggccgagggcaagggcgtgagtgtcgcccagaccgcgatcgcctgggtgctcgcgcaggggccccggcacggggtcgacatcgtgccgctggtgggcgcccggcgccgggaccggctcgccgaggcactgggtgccatggacgtctccctcgacgccgccgacctggcagccgtcgaggaggccgtcccggcgggcgcggcggccggggagaggtacccggcggcccagatggcccacctcgacagtgagcactgagctgacggtacggtcgtacccatgcctcccgctgctgccgagcccctgactcccgagcgcatcctcgcgaccaccgaggaggtgctgcgccgcttcggtcccaccaaggcgaccgtggtggacgtggctcgcgccctgggtgtcagccacggcagtgtctaccggcacttcccgtcgaaggcggcgctgcgcgaggccgtcacggaccgctggctcgcccggagcgtggtcatgctggaggagatcgcctcggctcccaccgggagcgccccctccaagctggaggcgtggctggaggccctcttcgaggccaagcgccacaaggcgggcgacgatccggagctgttcgccacctacaccgtgctgctcgccgagaacagcggcgtggtggacgcgcacctgagtgaactgatcgaccagctgggccgcatcatcgccgagggtgtcgcggcgggctcgctctccgccgaggacgtgccggcggcggctcgcgcggtcttcgacgccaccggccgcttccacgacccgcagtacgcggcggactggctctcgccgacgatcatcaccgagttcgaggcggtcaccgctctcgtgatccggggcctgcgcgcctgacgcggggtgaccaccggccctcatcagtcactccgggcgacttgatgatcattttgggcgcgttccggttgtttgcgcaccgtcgatctacttacggtccccctaccgcactccatcaggcctgttccagggggaacgttgtccactccagcaatacaagacacccagccgggacctccgaagcgctcgggcgctgccaccgccctcggctggatcgtgaccatcgggctcaacgtggtcgcgccgatcatcacgtacaacatgctcagcgaccacggctggagcgagttctccgcgctgctgctcagcagcgcctggccggtgctcgacagcgtcgtcagcctggcctggcggcgcaagctcgacgagttcgccgtcgtcaccctggtgttcctggtgatcacggccgtcgtctcgctcgccggcgcgcactcggcccgcgccctgctcatcaaggactcgggggtcaccgggctgttcgggctgctctgcctggcgacgctgctcgcaccgcgcccgctgatgttctacttcggccgcaagttcgccaccgacggcaccccgggaagcaccgcctggtggaacggcctgtggcagttcgagaccttccgcaccaccatgaaccggatgaccctggtgtggggtctcgcctacatcaccgaggccctcgtccgcgtcttcctcgcctacacgctggagaccaagaccatggtggtggtcagcccgatcatgatctacggggtgctggccggactcggcgtatggaccgccctgtacgggaagcgctccaaggccgagggagagcgccttgcggccgagcgggaggcccgggaggctcgggaggcagcggcctcctgacccggtccgccgggtccgcccgtacaaaaagaccggtggcccggtgcgctcgcagcgcaccgggccaccggtcttcgtacggcaggacctagcagccgagcagacggctgccgaggtaggcctggatctggtccagggagacgcgctcctgcttcatcgtgtcgcgctcgcgcacggtcaccgcgttgtcgtccagggtgtcgaagtcgacggtgacgcagaacggcgtaccgatctcgtcctggcggcggtagcggcggccgatggcgcccgcgtcgtcgaactcgatgttccagtgcttgcgcaggtcggcggcgaggcccttggccttcggcgacagctgcgggttgcgggacagcggcaggacggcgaccttgatcggggccaggcgggggtcgaagcgcatcacggtgcgcttctccatgacgcccttggcgttcggggcctcgtcctcgacgtaggcgtcgagcatgaaggcgagcatggcgcggttgacaccggcggccggctcgatgacgtacggggtgtagcgctcacccgactcctggtcgaggtaggtgaggttctgaccggacgcggccgagtgggccttgaggtcgaagtcggtgcggttggcgacaccttcgagctcggagaactcgttgccaccgaagttgaagcggtactcgatgtcggcggtgcgcttcgagtagtgggacagcttctccttcgggtggtcgtaccagcggatgttctcctcgcggatgcccaggtcgcggtaccagttccaccgctcctgcatccagtactcctgccactgctcgtcctcgcccggcttgacgaagaactccatctccatctgctcgaactcgcgcgtgcggaagatgaagttgcccggcgtgatctcgttgcggaaggacttgcccatctgcgcgatgccgaagggcggcttcttgcgcgaagtggtctgcacctgggcgaagttggtgaagatgccctgggcggtctcggggcgcaggtacgccttcgagccggtgtcctgggtcgggccgaggtgggtctccagcatgccggagaactgcttgggctcggtgaactggcccttcacaccacagttgggacagttgatgtcggcaagaccattggcgggcacacggccgtgcttggcctcgtacgcctcttcaaggtggtccgcgcggtggcgcttgtggcaggaggtgcactcggtcagcgggtccgagaaggtggcgacgtggccggaggcgacccagacctcgggggccaggatcacggaggagtcgataccgacgatgtcctcacgcccggtgaccatcgccttccaccactggcgcttgatgttctccttgagctcgacaccgagcgggccgtagtcccaggcggccttggagccaccgtagatctcactgcacgggaaaacgaagccacggcgcttgctcaggctgacgatggtttcgatcttgtcggcggccacggtgctctcttcattacgaggacgaacggcgaagtctttagattaccggcgcccgcaccccccctttcaaatcggttccccttccacgcccgcccacccgggcctcccacctgggtttttgacaatcgtttccatctttgatgaaaatggatgtcatgaacgtacgacgcctcatacccgccgccgccctcgccggagccgtcgccctcggcgccacggccctgaccgcctgctccggagccgctgccggcaccggcggcggcaaggacggcaaggtcggcgtgacggcgtcgttctacccgctgcagttcctcgccgagcagatcggcaaggaccacgtgaaggtcgacgtcctgaccaggcccggcgtcgaaccccacgacctggagatcaccccgaggcagaccgggcagctcggcgaggccgacgtggtcctctacctcaagagcctgcagcccgccgtcgacaaggccgtcgcccagtccggcgtgaagaacatcgtcgacgccgcgaccctcaccgaactggaggcgcacggctcctccggccacgaccacggcgccgaggaggcccacgccgagggcgagggccacgaccacgatcacggccacggcgagggcgcccgggacccccacgtctggctcgaccccgtcaagtacgcggagatcgccaagggcgtcggcgcctccctggagaaggccgaccccgaccacgcggcggactacaggaagaacaccgacgaactcgtcggcaaactgaccgcgctggacacggagttcaaggacggcctgaagaacacgacctccaggaccttcatcaccacccactccgccttcggatacctcgccgagcgctacggcctcgaccaggagggcatctccggcgtcgaccccgagtccgaaccgagcccggcccggatgaaggatcttcaggccgtcgccaggaaggacaatgtcaccaccgtgttcttcgaggccctggccagcgacaagacggccaagaccctggcgacggacaccggcctgcggaccgacgtcctggacccgctcgaaggaatcaccgacaagtcccagggcgctgactacttcgaggtcatgcggtccaacctgaagaacctccagaaggcgctcggagccaagtagatgacagcagcaacggaggcgcgagccatgcagtccacgccaggacggtccgcggaccagccgcccgtcatatccctgcgcggggccacggcctcgctcggctcgcgccccgtgctgcgcgggatcgacctcaccgtgcaccgcggcgaggtcgtcgcgctgctcggcgccaacggctccggcaagtccacggccgtccgcgcggtcgtcggccaggtcccgctgaccgacggctccctcagcctcttcggcacggagttcaagcgcttccgcgactggtcgcgcatcgggtacgtcccccagcgcaccaccgccgccggcggcgtcccggccaccgtccgcgaggtcgtctcctccggccggctcgcccgctcccgcttcggcctgctgcgcaaggccgacaggaccgccatcgagcacgccctggccctggtcgacatggactcgcacgccgaggtctcggtggacgccctctcgggcggccagcaccagcgcgtgctcatcgcccgggcgctcgccgtcgaacccgagctgctgatcatggacgagccgatggcgggcgtggacctcgccaaccaggaggtcctggcgaacgccctgcgcgcgcaggtcgccgccggctccaccgtcctgctcgtgctgcacgaactgggcccgctggagcccctgatcgaccgcgccgtcgtcctgcgcgacggctgcgtcgtccacgacggcccgcccccggaggccgtgggacagcacgccctgcccggccacgaccacgtacacccccacgcggcgcacgacgccgggcccctgcggacgggactgctgagctgatggacatcctcgactacgccttcatgcagcgagcgctgatcgcggccgccctggtcggcatcacggcgcccgccatcggcacgtacctcgtccagcgccgccaggcgctcatgggcgacggactgggccacgtcgccatgaccggtgtcgccctcggcctcgtgctccagaccagcccggtctggatggccaccctcgtcgccgtcctcggcgccgtcggcatggagctgatccgggcccgcggcaagaccagcggggacgtcgccctcgccatgctcttctacggcggcctcgccggcggcgtcatgatcatcaacctcgggggcggccagacggccagcctcctgggctccatgttcggctcgatcaccacggtcgccgccgaggacgtgaccgcgatggcgatcctcgccgccttcgtcctcgccgtggccatcggcctgcgcaggcagctcttcgccgtctgccaggacgaggagttcgcccgggtcaccggcctgcccgtgcgcgccctgaacctgctgatcgcggtcaccgccgcgatcaccgtcaccgtcgcgatgcgcatcgtcggcctgctgctggtcagcgcgatgctggtgatcccggtcgccgccgcccagcgcctcacccgcagtttcgccgcgaccctgggcctggccatggccatcagcgtgaccgtctcgctgaccggcacggcggccacctactacatcaacgtgccttcgggcgcgacgatcgtgctgctcgcgatcggcgtcttcatcgcgatgacggccctctccgcccccctggcccggcgccgggccagagcctcgctcgcggccgaagaggtctgcacgcgcgacgatgtgaaggtctagcgggctggcacaatggccgcaggcctatacgaggaggaaccggtggcgactgcgcctggcgagatgaataccgcgccagtacgaggacgatccacccggcagcgggccgcggtcgcggcggcgctggacgaggtggacgagttccgcagcgcccaggagctccacgacatgctcaagcaccgtggcgactccgtgggcctgaccaccgtctaccgcaccctgcagtccctcgcggacgccggcgaggtcgacgtcctgcggaccagcgacggcgagtccgtctaccgccgctgctccaccggcgaccaccaccaccacctggtctgccgcaagtgcggcaaggccgtcgaggtggagggcccggccgtggagaagtgggcggagtccatcgcggccgagcacggctacgtgaacgtggcgcataccgtggagatcttcggcacctgcgccgactgcgccgccgcgggctagagccggcgcaggttcgcgtccaggaccgcccgcagcgcgtcggcgtcggccggtgcctggatcccccgcttgggcaggacggtcatggccaccgcctgcttgtcgtcgctgagcatgacgaacgcatcggccgtctccacgtacctcggctgcgcggcccagccgatgcgcgactcgcaggacgccgccgtcaccagggctcccgagccgtcgatgacggcccgggtctcccccgccctctccagcagtccgcggaaggcgcgtgcctggagccgcgggccgaacagggtgatcacccacagcagcaggccggcgcccatcatgccgagcggcgccccggcgacggtcccgtcggtcaccaccaccagcactccgacgcccatgccgaacgtccccccgacgggaaacagccatcgcttgcgccgccccgccgccgtgtgcgcgtcccgggcacggagtgcctgcgcgatgtccgccgtggtggtccggtatacgagctcgacggtccgctcgtccggccggaccacctggtcattcgtgttcatgacagcggaccctaccggcggggcggcctccggcggataccggcccgtgtcaggcggtgggctccggctggttcgggagggcgccgccgaagcggcggtcgcgctgggcgtattccaggcaggcccgccacaggtcacggcggtcgaagtcgggccacagcacgtcctggtagaccatctcggcgtacgcgctctgccagatcaggtagttggaggtgcgctgctcgccgctcgggcgcaggaacaggtccacgtccggcatgtccgggtagtagatgtacttggcgaaggtcttctcgttgaccttcgacgggtcgagcctgcccgccgccacgtcccgggcgatggcctgcgccgcgtccgcgatctccgcgcggccgccgtaattgacgcagaagtacagggtcatggcgtcgttgtcgacggtctgctcctgcgcgacctggagctcctggacgaccgacttccacatcttcggcatgcggccgacccagcggatgcggatgccgagctcgttcatctcgtcgcggcggcggcggatgacgtcacggttgaagttcatcaggaagcggacctcgtcgggcgagcgcttccagttctccgtcgagaaggcgtagagggagaggttcttgacgcccatctccaggcagcccttgagcacgtcgagcacgacgccctcgccgaccttgtggccctcggtgcgcggcaggccgcgttccttggcccagcggccgttgccgtccatgacgatcgccacgtggttcgggacgagctcgccggggatcttcggggggaccgcaccggaggggtgcggctcgggaaccttgtactcccggcgagagcgtcccagaatcccgcgtcgtgccatgtgtccagctcctatttctcgacgtatcgcagggagcgtagcccgcgctccagatgccagtgcagataggcggagaccagcccgctgccctcccgcacatgacgcgcctcgcacgcgtcggcatgcccccagtcgcccgtcagcagggcgctgagcagggcgatggcctccgatgagggtacgacgctcccgggcacccggcagtccccgcatatgaccccgcccgctgcgacggagaagtgccggttgggtccgtggatgccgcacttcgcgcagtcgtcgaagctgggcgcgtagccgttgacggcgagggagcgcagcaggaaggcgtcgaggatgaggtggggctcgtgttcaccgcgggagagggtgcgcagggctccgacgagcagcaggtactgctgcaccgcgggctcgccctcgttctcggtgaaccgctcggcggtctccagcatcgcggtgccggcggtgtagcgggcgtagtcggtgacgatgccgttgccgtacggggcgatgatctgggtctgggtgcagagcggcaggctgcggccgatcagctcgctgccgcgggcgaagaactgcacgtcggcgtgggagaaaggttccagcccggcgccgaatttggacttcgtgcgccggaccccgcgggcgacggcccgcacccggccgtggccgcgggtcagcagcgtgatgatgcggtccgcctcacccagcttctgggtgcgcagcacgatgccgtcgtcgcggaacaggctcatgcgcccattgtcccgtacggcgacgcaacggcgggcagggtgtccccgccgtgaacggcagcggccccggccgggcgcggggcccggccggggccacccccttgggagggtcaggaggccggtgtccgggctgcttcgccctcacccggctgggccggtacggctgctgaggagtccgtgtccgcctccgcggcctgggcgggcagttcgacctcgacctcgggggcgtcgtgggcgccttccttgcccaggccgttgaagaccaggttgaggacgatggcggccgtggcaccgagcgtcacaccgctgttgagcagcgaggacaggtccgggtccatgtgcttggagaagaggaccgggacggtcgcggggagcagggcgaaggcgagggagacgccgacgatcagcgcgttcttctcctccttcaggtccaccttggccagggtctggataccggccagggcgaccatggcgaacatgacggtcgcggcgccgccgaggactccgtgcgggacgccggcgacgatcgcggcggccttgggcagcagacccagcacgatcatgaagacaccggcggcgacgaccacgaaccggctcttcaccttggtcatccgcaccaggccgacgttctcggcgaaggccacgtacgggaaggagttgaggacaccgccgagggcggtcgcggcaccgtcggcacgcagggcgcgggcgacggtctcgctgtcgacctccttgccgacgatgtcaccgacggcgtaggtgtcgccggtcgtctcgaccatggtgatcagcatgacgatgagcatcaggacgatcgggaaccactcgaacttcggggcgccgaagtggaagggggtggtgatgccgacccactcggacttgctcacgtcgccgaacttcgcgtcgccgagcaggaaggcgacggtggtgccgacgaccaggccgaggaggatcgagatgctggagaggaacggcttgccgatcttcatcaggatgaggatgaagagcatcgtgccgccggcgtaggcgaagttcttcgggtctccgaagtccgggctgccgaggccgccggccgcgtcgttgagaccgaccgggatcaggacgatgcccagcacggtgatcaccgtgccggtcacgaccggcgggaacagccgcatcaccgtccggaacgccttggccggcagccaggcgaaggcgaaggtggcgataccggcggtgatcaccgcgccgtagatgaccagcagggccgcggtaccgccgccggcgccgaggcctatggcgatcatcggggagaccgcggtgaaggtcacgccctggatcagcggcaggcgcgcaccgatccggccgatgccccaggcctggatgatcgaggcgataccgcaggtgaagaggtccgcgttgatcaggtagaccagctgttcagggctcagcttcagcgcgttgccgacgatgatcgggacgatcaccgcgccggcgtagaaggcgagtacgtgctggaagccgtacagcgcgagcttggggagggggagcacctcgtcgaccgggtgcgtgctctgctctccgtcggtggaaagccgggcggcgacacgtgccatctcagccttgcccttcaaggtaggtaagtgagaggagatctggttgtccctggacgtagtgggtcgctaacccgttggtacgccggggttgtcagtgcgttcacggtgacgtgaaccgaagccgcgctgtggggactgcgccgtcttgtcgtgtgaccggaattgaacgcctgtgggtggcctcacacatatcgtcgacttcgacaaactgttgacgttcaggccaccccgatctgtaggtttctccagtggtgcggagtcctcggcaggggtatgcgcaccgtggtgcgcagccatgcgcacccgccccgcgcccgcccaggacatccacggtgacgtgcggatacgtggtgtgcggcccttcggaggggcacacccgaaggcgcggttccggccgtccgactggtggacacttcgggaaccgagcgtgcgcctgcgcccttcacatggcgttcacacgccccgaatcaggccctgcgaggccggatcgttacgtcgcggaaggccgtttcggacggaacgggccgctccggagtccacggatcggacacgagcggccccgggcgaggagttcgcgcggggccgctcgtgtgagatccgggaaccacgtgcctgacggcgcatcgccctcagggcgcgcgtaccgccgacagcagccgggtcacctcgtccgtgtcgatccgcagcgccgagccgaccgtggcgagcacctcgcgctcggccggggtgtacgggccgtccgcgagcgcgatacgggccccctggagcaggatcgattcccggcccgggccggccaggtgcggggccagcggttccagggcctcgtggagctctatcgacagcgcggccccgcagcactccgggacgtcgtacaggccgagccggccctcgtccgaggacagcgcctccacgagggactgcagctgctcctcggtgcagtcctggaagcccgcggtccgtacggcgcccaccgcggcctccagcgcgccccgcgaggccgttccgcccgcggtcagtacggccagcgccaccgtgtgcacggcgtcccgcaggagggcggtgaagcgggtcgtggtgaggtggtccaggacgtcggtggcgaagcgcgcacggcagccctggcactcgatgacgggcccggcctgcccgcggggcagcagcggcaccccgaggacggtgaaccggcgccgtccggtccgcctccggtaattgcggtccccaccgcaggcggggcagaagaactccccgtcacccacggtgctccaggtggtacgggtgccccagaccgtcagcttccggccgtccccaccccgaactggcagcacgtcgcacctccgtaaccttccggcaacatcgccgggtgggcgtgatgttagccacatcgatgaggatgcgtcagtcgtgtgacaagacaacatgtgccgggccccggacttggccggtctgcgtccccggcgtccccccgccccctccccgttccctctagggttcgccgcatgaacgagaagtcctgtctggtcaccggtgccgcgagcgggatcggccgggcaaccgccctgctgctggcccgctccggggcccgggtgaccgcggccgacatcaatggccccggggtcgaggccctgtgtacggaactggccgacgaggggtgcgcggtcaccgcggtcaccggtgacgtcgccgatcccgagtccaatcgcgcgatggtcgcggccgccgtcggggcctacgggcgcctggacgtcgccgtggcgaacgccggggtgctccccctctccgacgtacgcgagaccagccccgaggactgggaccacgtcatggcggtcgacggccgcggaatgttcctgacctgcaagtacgccatcgaggcgatgaccgcgcagccgcgccccggcggggccctggtctgcgtgtcctcgatctcgggggtggccgggcaggcccgccaggccgcttacggacccgcgaagttcgtggcgtcggggctgaccaagcacctcgcggtggagtgggccgcgcacgggatccgggtcaacgcggtggcaccgggaaccatccgtacggagcgggtgatcgcgctgaaggacgagccgggcgggccggagtacctgactgaggtcgaggccgcccacccgatgggccggctcggcgagccggaggaggtggcccgggtcatcgccttcctggcctcggacgcggcctcgttcgtgacgggcgtgatcctgccggtggacggcggctacctggcccgctgagcccgtccccgcccgggcggggacgacggaaccccgccccctccggaagggagggggcggggttcacgtacgggggatcagcggcccgcgcggttgacggcggagatgaccgccttcagggaggcgcgggtggtgttggcgtcgatgccgatgccccacaggacacggccctcgatcgcgcactcgatgtacgaggcggccacggcggaggcgccctcgctcatggtgtgctcggagtagtccagcaggcgggcgtcgacgccgatgccggccagcgcgtcgaagaaggccgagatcggaccgttgccggtgccgttcaggaccgtctccacaccgtccacgaccgcctcgacggtcagcgtgtccgtgccgtccttgtcggtggccgtcgaaccggagcgcagctggatgcggccccacgggttctccgggttgggcaggtactcgtcctcgaagaccgaccagatcgccttcggcgtgacctctccgccctcggagtcggtcttggcctggatgatccgggagaactcgatctgcatgcggcgcggcaggtccagcttgtggtcgttcttcaggacgtacgcgatgccgcccttgccggactgcgagttgacccggatgaccgcctcgtaggagcggccgacgtccttcgggtcgatcggcaggtacgggaccgcccactcgatgtcgtcgacggtcttgccggcggcggccgcgtcggcctccatggcgtcgaagcccttcttgatggcgtcctggtgggagccggagaaggcggtgtagacgaggtcgcccgcgtaggggtggcgcgggtggacctccatctggttgcagtactcgctggtgcgacggatctcgtcgatctgcgagaagtcgatctgcgggtcgatgccctgggagaacaggttcatgcccagggtgatcaggtcgacgttgccggtgcgctcgccctgcccgaacaggcagccctcgatgcggtcggcgccggccatcagggccagttcggcggcggcgacggcggtgccgcggtcgttgtgcgggtgcacggagatgcagatgtgctcgcggcgggtcaggttgcgggccatccactcgaagcggtccgcgtgcgtggacggcgtggaacgctccacagtggcgggcaggttcaggatgatctcgcggccctcggccggctgccagacgtcacagacggcctcgcagacctccagggcgaagtccagctcggtgtcggtgaagatctccgggctgtactggtagccgaaggtggtctcgggacccagcagcttctcggcgtactccatgaccaggcgggtgccgtcgacggcgatctgcttgatctgctccttggagccgcggaagacgacccggcggaaggtcggggcggtcgcgttgtacaggtggacggtggcgcgcttggcgccgaccagggattccacggtccgctcgatcaggtcctcgcgggcctgggtcagtacggagatggtgacgtcgtccgggaccgcgccctcttcgatgatggagcgcacgaaggcgaagtcggtctcgccggaggaggggaagccgacctcgatctccttgtagcccatgcgcaccagcaggtcgaacatctcgcgcttgcgggcgggggtcatcgggtcgatcagcgactggttgccgtcgcgcaggtcggtggagagccagcggggggccttggtgacgcgggcgtccggccaggtgcggtccgggatgtccacctgctcgtaggagccgtacttgtggatcggcatcccggagggcttctgggagtgggtcgcgttcgtgatgggcgtggggcgaccgacaaaaggctgctggctcatggcgttgggctcctcgcgtgtccgcgtgtagttcgctgggacggccgacggcggtagtgaaaaccgcaacaccaaactccgcggggagggggtcggcctacgactacagaccctcgccgcggcagctaaggagaagcagcccgaaacgcatgatgggccgagcctagccgagccgcgccgtatcgcgaggacctgtttcagtatgcaagacccgagggtccgatttgcaccaaatgtgagccaagcctcgtttgctccgtcccggtccggtcattccgtcaatccggcgccgccgctttcagacaagcgaatgaatcatggtcgcaggtagtgacagcgtcatgacccactgccacattgccgggcatggatgcctcccacgcacaccgccatcaccccgtcttctgcaccgtcgtaccgccgcacctcctcgacaaggccgcccggtccgaggactcccgccgcgccgacctcgcccagcgcaccctggaacgcgactccctgctgcgcacccggcggcgggtcaccgccgtccggggaatcgtccccgccctcgccgtaccggcctccgacgatccggaccggaccgtctacgacgcgcagcaccgcacccggctgcccgggaagaaggtccggggcgagggcgacccgctgagcaaggacgccaccgtcaaccgcgcctacgccgggctcggcgccacctacgaactgttcctgaagggcttcgggcggcgctccatcgatgacgccggtctcgccctggacgccaccgtccattacagcgaggactacaacaacgccttctgggacggccagcagatggtcttcggggacggggacggcgacctcttcctcgacttcacggtctccgtggacgtcatcgggcacgagctgacccacggggtcacccagtacacggcgaacctgacctaccacggccagtccggggccctgaacgagtcgatgtccgacgtcttcggctcgctgatcaagcagtactcgctggagcagacggccgaggaggccgactggctgatcggggccgggctgctcggcccgaacgtcaccggggtcgcgctgcgctcgatgaaggcgccggggaccgcgtacgacgacgacgagctcggcaaggacccgcagccggccaccatggacggctacgtgaccacccacagcgacaacggcggggtccacatcaactcgggcatccccaaccacgccttctacgtcgtggcgaccgagctgggcggcaaggcctgggagcgggccggacagatctggtacgacaccctgaccggcggcgacctcgccgagaacgcggacttcgcggacttcgcgcggctctcgacggcggcggccgtgacccggtacgggcacggcggcgcggagcaccaggcgctccagaaggcgtggtccgcggtgggtgtcccgctcgcggggtagacggctcccatgcgcattcaggtgatacggacgggcggcttcgcgggcatcgagcgccgggccgaggtggacaccgcgggccggccggacgaggacgagtggcgggccctggcccagctcgcgctgcggcccgctccgccgggcgacccggcggaccgggtacgggacggcttctcctaccggatcacggtggacggccgcacggtggcctgcgcggagccgaacctgtcggagtcccagcgggcactgatctcgcgcgtactgaaggaaggcgcctgagggaaggcgcctgacggaagcgcctgaccaggcctgagcggcccggaaagaaggtgccccggcagcgccgctttgtttggatgaccggatgaccgaccacatgatcgattcaacgctgtccgagctggagcgctactacgacacggtgccgcgggtgggcggggcccgcggcgaggacttcgggccgctgaccctgttcgtccaggagggcgcgggctggccgtactacgcgcggcccgcgctcggcgggtccgcggcgaccccggccgatgtgcggcgggtacgggagcgccagcgggagctgaaggtgccggaggccttcgagtgggtggccgaaaccagcccctcgctgcgggctgccgtggaggccgcggggctccatgtccacgcgcaccccctgatggtgctggaccccgcggccgaagcccttcccccgcacccggaggtccggctgctcgggtccgacgacccgttcctgaccgccgcggtgaccgtaccggccctggccttcgcggccccgggaacggcgatcggcgaggccggccccgcggaactggcggcggcgatgacgcagccgtcggccgaggagggccgcgcccgggtgtccgccaagctggctgcgggcaccgcggccatggccgcggccgtacgggacggtgtggtgctctgctcgggcctgtacaacccggtcggggacgtcgtggaggtcgtgggcgtcggcacccttccgtcggcccgccgccagggcctggccctcgcggtgacggccgcgctcgtcgccgaggcccgggcgcgcggggcccgtacggtcttcctctcggcgggcgacgaggacgtggcgcgcgtctacgcccgcatcggcttccgccgggtggccacggccctgatcgccgaacccgcggagtgatccgccgactcacgcggctgtgggaagcccgccgggcaggagccgggcccgaccgggcgctcgaccctgccggggcggagcggggcgggcacgcgcggttctgacgccgtcggattcctctttgccgggtcggcaacaaagtttgccgtaggtcgtggggcgggcgcagcatcggccgtaccggcacccgtactggaagagggacccatgaccgagcacgcgcacaccggcacgcacgcccaccaccaccccgctcccgggacggaggcgggcgaggagttctgggacggccgctacggggagagccaccgcatctggagcggcgagcccaacgccatgctcgtgcacgaggtgtccgccctcgccccgggccgggccctggacctggggtgcggggagggtgccgacgccgtctggctggcccgccgcgggtggacggtcaccgggaccgacatctccggggtcgccctcggccgggcggccgagcacgcggcgcaggccggggtcgcggaccgcgtgtccttcgcgcggcacgatctgacggagaccttcccgcagggggagttcgacctcgtctcggcgtgcttcctgcacaactacggcggcttcccccgggacgccgtcctgcgcgcggcggcctcggcggtggcccccggcggcaccctgctggtggtcggccacgcgggctgggcgccgtggcaggaggagcgggaggaggcgcacttccccacgcccgaggaggtcctcgcgcagctggagccggtcacggcggactgggaggtgctgcgggccgaggagaccgagcgggtccagaaccagcccgacggcacgcccggaacccgtacggacaacgtggtgcgggtgcgccggcccgcataggcggacgcacggacggacagacagccggacgcggcccccgatcgggggccgcgtccgtgcgtgtgccggtctcggcgcgtcgtgccgtgccgcgcgtcagaagccgagcttgcgcagctgcttggggtcccgctgccagtccttggcgaccttcacgtgcaggtcgaggaagaccggggtgccgagcagcgcctcgatgtgcttgcgcgacttcatcccgacctccttcaggcgggagcccttcgggccgatgatgatgcccttctggctcggccgctcgatgtagacgttggcgtggatgtcgagcagcgggcggtccgccggacggttctcgcgcgggatcatctcctcgacgaccacggcgatggagtgcgggagctcgtcccgtacgccttccagcgcggcctcgcggatcagctccgcgaccatgaccatctcgggctcgtcggtgaggtcgccctccgggtacagcggcgggctctcgggcagcagcggcgcgatcaggtccgccagcagctggacctgggtgtcgccgaccgccgagaccggaacgatctcggcccactcgaagccgagctcggcgccgagctggtgcacggccaggagctgctcggccagctgcttggactcgaccaggtcggtcttggtgatgatggcgatcttgggggtcttcttgatccccgccagctccttggcgatgaacttgtcgccggggccgagcttctggtcggccggcaggcagaagccgatgacgtcgacctcggcccaggtggtccgtacgacgtcgttgaggcgctcgccgagcagggtgcgcggcttgtgcaggcccggcgtgtcgacgaggacgagctgggcgtcggggcggtgcacgatgccgcgaacggtgtggcgggtggtctgcggccggttggaggtgatcgcgaccttggtgcccacgagtgcgttggtgagggtcgacttccccgcgttggggcggccgacgaagcaggcgaaccccgcacggtgcggggcggtggactcgggggaacgatcgctcatacgggccattctccccgatgcggctcccagcgccgaccagatcacggcggcgagggccggaacagccgtcagcgcggggtactcggcatggcccgcacggccctgagctgtggttccgtcggcccgggcgcgaacggtgacctcggcccattccgctctgggcgcgccctcccaacgggcgctgagccgtacttcctgacccggcagcagttcggcgggcagcccgccggcctcgcgggcgaggagggggcggccgagggcgccggtggcggtgagggtggcccgggggtggagggtgacgttgccggtgttgtggagcgtgtacgagatgtccgcgccggagccgcgccgtttcacggtgaccccgcggacggcgagggcgggggcggtggggccggtcacccgcaggtacagccgggcggcgacggcctgctgtacgccgatcccccggccggtgccggccgcggcggcgggccgttcctccagggccacgacggcgccgggatggtcccccggctccgcccgttcggggacggtcacggtgaagccgacggcgaccgacgcgcgggccgccacggtgacccgttcccggtcgagcttcgcccacgcggcggtggccagccgcggctcgtcgggtccccgcagggcgaagccgccgtcgcgggcggtgttgtaggcgtcggcggcgtagaggcggaaggtgcgggggcggtcaccgcggttggtgagggtgacggcgtcggcgacggactggctgggcgcggcggcgaggtagaagcagggccgctgcccgacggtgttcgcgacgggcagcacggaccacggcccgttgtccgacgctccggccgttccgctgagcccgacgacgatcggcaaggtcgccccggcgaaggcgagcgctgcgcggagccgtcctctgcccgcccttccaccgttccccgggctccgcccggacccggtcctcaaacgccggacggatgcggccccgccaggcgtcatgacagggtcagggtcaggaccgccgtgtacgcgcccggcggggtgtacggcggcacccgcagggtcaccgtggcgtcgatcgtgaaggtgccgccgaccagcggggcgtccggggcggaggccaggagcgcgccttccggaccgacgacgcccgcactgcccggcgtacaggtgctccggctgccctcggccgccacgcacctcggggtccaggacagggaggcgcccgggatgcggatcccgccgggtccggtgaagtcggtgaccttgccgatcagggaccagccggccggtccgccgcgggcgtcggtgacggtcaccgtcccgatccggcccggggccgcgccgccgtcgccgtaggacacggcgcccagggtgatgtcctcgcccgtctgggtcatgcccaggacgcccggctcgacggtggcggtgaccttctgcgtaccggaggacggcggcggagcggcgtcgacgaccgtgtacgcggccgggcccgagccctggcgcgccgaccaggcggcgccctcgtaggcgatcaccgcggtggtggccctgtccgtgaccggcagctcgaccagggccgtacccaggccgtcggcggtggcgctcgcccggtcggcggtctcggccgcgccggcccgcccggccacggtgacggccgcgcccggcgggaagccggcggcggtgaccttgaccctggcgcccggcctgccctgggccgcgccgaggaacacgctgcgcaggttggccgtcggcagcgcggtcgcggtcaggcgggcggagacgggggcggcggacccggcgtcggcggtgcaggtggtgtcgaggtccagcccgtggctggtgtgcagggtgtagccgcccggggcgagcgtggtctcgccgggcgcggtgaccgtgaaggtgccggtcatcgtgacggcgggaagggccgcgcccgccgggacggggtcgttgcgcttggccccgaccacggtgacctcaccgctctgggcgcccgccagcaggatccggccggtgggggtcagggagtcggcggggagttcaccgccgaccgggttgacggcgggcgtgcggagcacctggtaggtgacggtgacggtgtcgccgacctgcggggccgggttgtcgacggcgatccgcgcggtgggcggcccgtccgcgggcggcagcccggcctcctggggcgccgggcagtgggtcgggaagtccacccggccggggggcgtctccccttcggccgcggcgggtgcgccgagcgcgcccccggtcgtggccgccagcacggccattcccacggccgccggccatctccgcttccgcgccgctgttcgcactgcccgccccctgggttcccgcgcgcccgagcccggcgcagggggccattcacaggtggggggcgggagaagtcaatgcacgggtccggcatcaactgatggcccatcagaacatggcaggttgtccgccgggccggtcccgcccgccgcccggaaggtgcggcggtaggcggtcgggctcacccccagcgccgcctgcacgtgcttgcgcagcgactgggcggtgccgaagccgctgtcccgcgccacctgctccatcggcagctccgtctgctccagcagcctgcgggccagctccacccgccggccgacgatccactggccggggctgacgcccgactcctcacggaaccggcgcgtgaaggtccgtaccgacatggcctcctgccgggccagatcggtcagccggagcggttcgtgcagccggtccagcacccatgcgcgggccgcggtggtggtggcgagctgcggctccggcatcgggcgcgcgacgaactgcgcctgcccgccctcccggtggggcggtacgacggtccgccgggccacctcgttggcgacggccacgccgtggtcgcggcgcacgatgtgcaggcacaggtcgatgccggcggcgactccggccgaggtcagcacgtccccgtcgtcggtgtagagcacgtccgggtcgacccggacggccgggaagagccgctggaagtgctcggcggaggcccagtgggtggtggcggggcgcccgtccaggtagcccgcggcggcgagcacgtagccgcccgtgcagatggagacgagccgggtgccgggccggatgtgggcgagggccgccgcgagctcgccggtcagccggccctcctcgtacgccggacccagctcgtacgaggccggcaccactaccgtgtcggcggtggccagcagctccggaccgtgctcgacgtggatcgcgaagtcggcgtccgtgcgcaccggccccggggcgagcccgcacgtgaggatctcgtacagcggccgcccggccgggtccttggcccgcccgaagatccggtgcgggatgccgagctcgaagggcagcagcccggcgagggcgaggacgacgacgcgatgggccttctgctccggcttcagcgactccatggcccgatcgtagcgaagcatgacagtcaagccactttcgtacggtcccccggtggccggaagctgtcggcgtgacccagacagccccggcctccacggccgccccgcgcggccccggaccgtccgcccgcatccaccgtgcctggttcgtcgccgccgtcgccttcgtgacgatcatcggcgcggccggcttcgcgtccctgcccggactgctcatcgagccgctgcacgcggagttcgactggtcgcgcggcaccatcggcctcgccgtctccgtcaacctcgcgctgtacgggctcaccgcgcccttcgccgccgccctgatggaccgcttcggcatccgccgggtcgtggccctggccctgctcgtcatcgcctcgggctcgctggccacggtgtggatgacggagccctggcagctcgtactgttctggggcgtcctcgtggggctgggcagcggctcgatggccctggccttcgcggcgacggtgacgaaccgctggttcaccgcccggcgcggcctggtcacgggcgtcctgaccgcggccggggcctccggccagctggtcttcctgccgctgctggcctggctggtggaccaccacggctggcgccccgcgacggtgacggtctccctggccgccctgtccgtcgctcccttcgtgtggctgctgatgcgcgaccacccggcggacgtgggactcgcgccgtacggcggcacgtacgtcgagaagccggccccgacgccgggcgccacccggcgcgcgctgcgggtactcgtcggcgccgcccggaccgggcccttctggctgctggcgggcaccttcgcgatctgcggcgcctcgaccaacggcctggtcaagacccacttcgtgcccgccgcgcacgaccacggcatgccggtgacggcggccgccgggctactggcggtggtcggcgtgttcgacgtgatcggcacggtagcgtcgggctggttcaccgaccgcttcgactcccggcggctgctggccgtctactacgccctgcgcggggtctcgctgctcttcctgccgatcctgctggcgccgtcggtgcggccgccgctggtcttcttcatcgtcttctacggcctggactgggtcgcgaccgtcccgccgacgatcgccctgtgccgcgagcactacggggaggacggcgcgatcgtcttcggctgggtcctcgcttcgcaccaggtcggcgcggcggcggtggccttcctgggcggcttgacccgcgacctcaccggctcgtacgacaccgtgtggtacgcgtcgggcgcgctgtgcgcggtggccgcgctcatggcgatgacgatccgccggcggcctcggccggccggcccgctcctggtccagtagcctcgccgacgccgccgatcccggctgggccaaactcagccgggcccggcgaggctgaaaacggttggtcccgccgggaggctactggcccgccggagtggtggacttcagggtgccgtccggggccgccagcaggaccggggtctccgggccgccgaggtcgcggacggccgcgcggtcggcgtcggccggggcgtcggccgtgctgacgacggccgccgcctccagggaccgcgccccgctcgccacggccatcgcgaccgcggtctgcagcgcgctcagcttcagggagtccagcgccaccgtcccggcgacgtacgtgcggcccgtctcgtcccgcaccgccgccccctcgggcacctcgttacgggcccgcgcgctgcgcgccagcgtgatgatcttgctgtcttcggggtcgatcccggtggtgtcggtcatggtcgaaagcatagggagccgccccgcgcccccgcgcgaccaccccaccgccaggccgagggcaccgctacggccggtccagccgcagccgttcggccttcggcaggcccgcgaccaccaggtcgtacgagtcctccaccagctcccgcaccagccggtccggcaggccgccgggcccgcccaccgtcaccgtgttccagtgccgcttgttcatgtggtagcccggcacgatcgccgcgtgctcctcgcgcagccgcaccgccagctccggatcgcacttgaggttgaccttgagcggctccccgtccagcgccgacagcgcgaacaccttgcccagtaccttgaacaccgaggtctcgggcgtgaaggggaactcctccaccgccgcgttgaagtccagacagaacgcgcgcagctgctccggggtcactcgccctcctcccccgcggcctccgccgcggccaccggctccaccaggaccgtcacgatcttgttccgccggcccgccggggactcggccgtcagccgcagcggacgcccgtccggcagttccaccaccgaggaggcgccggcgatcggtacccgccccagcgccttggccagcaggccgcccaccgtctccacgtcctcgtcgtcgaaggcctcgaccttgaacagctcaccgaggtcggtgatgtccagccgcgcggtgacccggtagcggtcctcgccgaggtcctcgaccggcgggagctcgcggtcgtactcatcggtgatctcgccgacgatctcttcgaggatgtcctcgatggtgacgatgccggccgtgccgccgtactcgtcgatgacgacggccacgtggttgcgcacctgctgcatctcgcgcagcaggtcgcccgcgttcttggtgtccggcacgaagacggccggccgcatcgcggtcgagaccaggtcggcctcggcctcccggctgatgtgcgtcttgcggaccaggtccttcaggtagacgatcccgactatgtcgtcctcgttctccccggtcaccggaatgcgggagaagccggaccgcagcgccagcgtggtcgcctgacggaccgtcttgtaccgctcgatgcagacgaggtcggtgcgcggcaccatcacctcgcgcaccagcgtgtcgcccagctcgaagacctggtgcaccatgcggcgctcgtcgtcctcgatgagtgattcccgctccgcgaggtccaccatcgcgcgcagctccgcctccgaggcgaagggccccttgcggaatcccttcccgggggtgagcgcgttgccgatgaggatcagcagctgcgggatcggccccatgatccgggccagcggtacgaggacgtacgcggccgccgtcgccgtgttcagcgggtgctggcggccgatcgtgcgcggggagacgcccacggcgacgaaggagacgagcaccatgacggcgatggccaccagcagcgcggtccagttctcgccgaactcgtcgaggcagacataggtgacgagcaccccggccgccatctcgcaggtgacccggacgagcagggccacgttgaggtagcgcgtggggtcgccggcgacctgtgcgagcttctcgctcccgcgccggccctcccgtacggcctgctcggcgcggaaactggagatgcgggcgatgccggactcggcgcaggccgcgaaccaggccacgaccacgagcagcaccgcaccggtgatcagctggggggcgttcacgagacggtcggagccggggacggaccggtcatgccgcgctcaccgcgccagccgtcgacgatggccgcctggaggccgaacatctcggccttctcgtccggttcctcgtggtcgtaaccgagcaggtgcagcactccgtggacggtcaggagctggagctcctcgtccatggagtgctgcgtcggggcgtcctcgccctgcctcttggcgacctcggggcagagcacgatgtcgccgaggagcccctgcgggggctcctcgtcgtccttggtcggcggacggagctcgtccatcgggaaggacatgacgtcggtcgggccgggcagatccatccactggatgtggagctgctccatggcgtcctcgtcgatgacgatgacggagagctcggagagcgggtggatccgcatccgggtgagcgcgtagcgggcgatgtcgaggatcgcctgctcgtcgacctcggttccggactcgttgttgacgtcgatcgacatggtgcgctgggttctacttccgctggtggccgttcgcgccggcctgctggctgtcgtcgtacttctcgtacgcgtcgacgatacggccgaccagcttgtgccggacgacatcctcggacgtgagccgcgagaagtggatgtccgggaccccttccaggatgtcctgcacctggcgcagaccgctcctggcgccacccggcaggtcgacctgggtgacgtcaccggtgatcacgatcttcgagtcgaagccgagccgggtcaggaacatcttcatctgctcggtggtcgtgttctgcgcctcgtcgaggacgacgaacgcctcgttcagggtgcgtccgcgcatgtacgccaggggagccacctcgatcgtgcccgcggccatcaggcgcgggatcgagtcggggtcgatcatgtcgtgcagcgcgtcgtagagcgggcgcaggtacgggtcgatcttgtcgaagagggtgcccggcaggaagccgagccgctcccccgcctcgacggcgggccgggtcaggatgatccggctgacctgcttggactggagggcctggacggccttggccatggcgaggtaggtcttgccggtaccggcggggccgatgccgaagacgatcgtgttcttgtcgatcgcgtcgacgtaccgcttctggttgagggtcttggggcggatggtgcggccgcggctggagaggatgttctgggtgagcacctcggcgggcgtctcggcaggtccgtcaccgttgccgttgccgctcgccttgagcatggcgatcgagcgttccactgcgtcctccgtcatcggctgcccggtgcggagcaccagcatcatctcgtcgaaaagccgctggatcagggcgacttccgccgtcgcaccgatcgcgctgacctgattgccccgaacatggatgtcggccttcgggaaggccttctcgatcacgcgcaacagggcgtcgcccgagccgagcacggtcaccatcgggtgtgtggacggaacggtgaagtgggctcgcgcctgccccggcgcagggatgtgggctgtcggtgtctgagtcatgggccggcactgtggcctgcgcatacctcccgctgaggggccgcgccgatcgacgacctccggagtaccaagcgtacgtctccgccgctgcttccccgagaggttttaccgcgggatcgccgccgggcacaccctaggccgggtccgcaaagtcccacctgccacgcgacgcctggcaccgcacctcgctgcgttgtcgggcacgtccgagtacggccagtacacggacggccctccgccttgcgatgcacggcgccagacgccgcgtggcccgcccatcgggcggccggcgctactttgcggacccggcctaggccgggtaccggaagccgatcgtcggtacggccctgcgccgggccgccggggccccggcctgcgggatcaggtcgtccaggaagccgtagcggccgcgcagctcctgcggggcggtccgccaccagtgggccacctccggccagccgggggccgacagggagccgccgaactcctgcaccgacagggccgccgtcagtccggcgaaggcgagccggtccgcgagcggccagcccgccagggtgccggtcacgaagcccgccacgtagacgtcgccggcgcccgtcgggtccagctcgtccaccgtgatcccggggacgtgcgcggtctccccggtgcgcccgtccacggcgtacgagccgtccgcgcccatggtcaccaccgcgatcggcaccttctcggccagcgcccgggccgcggctctcgggcagtcggtgcgggtgtagcgcatcgcctcgcccgcgttcggcaggaaggcctcgcagtgctccaggtcggccagggcccccaggtcccaccgtccgctctcgtcccatcccacgtccgcgaagacccgcgagccgctgcgggcggcctcgccgatccactcctcgccgcggccgggtcccagcgcggccacggccgcgcgggcccgcggcgggcactgcgggaagggcccgggtcccgccggcggaggggcctcgtggccgtgcgagaccatcgtgcgctcgccctcgtaggccatcgacacggtgacggggctgtgccagccggggatggtgtgcgacatggagaggtcgatgccctcgccctgttcgagggcatcccagcagtactcgccgtagtggtcgtccccgaaggcggcggccagcgaggtgcgcaggccgagccgggccagggcggtggccatgttggcgacgccgccggggctggagcccatgccgcgcgcccaggactccgtaccgcgtaccggggccgagtcgaggcccgtgaagatgatgtcgaggaagaccgttccggtcaggaagacgtcgcagccgggttcctcggggtcacgcagcggaccgagcgggtcgactgcggctgcgcggatttcgtagtcccgaccggtcacggcgatctccccgttgtttctcgaaggcccgttcctgcatgacggtttcccgtggaaagctgccagccctgcccacaccgggcgggaccaaaacccagtgtggcgcagatcactgcggaacggcccttcgtcccacggaccactcggcgggcccgggcccggtccgggccccggcggggcccgggaccaccgtcagccccgcttgggcaggggcacccgcagcaggtccgcggccaccgtgagctcgccctcgaagccggccgcgcgggcctggcgctcgaacgcggccggatcggtgtagcgctgcgagaagtgcgtcagcaccaggtgccgtacgcccgcgtcccgcgccacccgggccgcctggccggcggtcatgtgcccgtggtcggtggccagccgttcgtcctcgtcgaggaaggtcgactcgatcaccagcatgtcgcagccctcggcgagcgcgtccacgccggggcagagccgggtgtccatgacgaacgcgaaccgctgtccgggcctgggctcgctgacctcgtccagggtgaccgcgccgagccgcccctcacgctggatccggcccacgtccggccccttgatcccgtgccgcgcgagcagctcgggcaccatgcggcgcccgtcgggttcggtgatccggtagccgaaggactccaccgggtgcgagagcagccgggcctccaggacgtacgaggacccctgcgcgagcacgccgtccgccgccaccggctcctcgcggagcgggacggtctcgcggtaggccgtggcgtagcgcagccggtcgaagaacttctgccccgaggccgggtagtgcgcggtgacggggtgcgggacctggtcgaggttgatccgctggatcaccccggcgaggccgaggctgtggtcaccgtggaagtgggtgatgcagatccggttgatgtcgtgcgcggcgaccccggcgcgcagcatctggcgctgggtgccctcgcccgggtcgaagaggatgccctcgccgtcccagcgcagcaggtagccgttgtggttgcggtggcgggtgggcacctggctggccgtgcccagcaccacgaactctcgtacggacacgtgctatccggggggccactggaggccgcggccgccgaggacgtgcgcgtgggcgtgccagacggtctgtccggctccggagccggtgttgaagacgatccggtagccgtggtcgtcgatcttctcgtcggcggcgacctgggcggcctcacgcagtatgtcggcggcgacacccggctcggcggccgcgagggaggccgcgtcggggtagtgcaccttggggatgacgagcacgtgcgtgggcgcctgcgggttgatgtcccggaaggcgacggtggtctcggtctcccggaccacggtcgccgggacggcaccctcgacgatcttgcagaacaggcagtcggcctgcggttccccggccattgcttcgcctcctgtgacggtgatcggtccgggcatcgtatccagccgggcggctgccacgggcgggcatttcggcccgtcgggccgagaccggggccgggcccgaccggaccgggagccggagcggaccgtcgggaccggaccgtcgggaccggaccgtcgggaccggcgcgggccgtcaggaccagcggccggtacgggccagcaggacggcgaccgcggccgtcccggccgtggaggtgcgcagcacggagcggcccaggcggtaggggtgggcgccggcctcggcgaagaccgccagctcctccggggagacaccgccctccgggccgaccacgagcaccacggaaccggccttcgggagctcggccgtggccagcgcctctgagggggtgtcccggtcctcgtggagcaccatcgccaggtcggcgccggccagcagcgccgccacctgcttggtcgacacggcctcggccacctccgggaagcgcacccggcgggactgcttgcccgcctcccgggccgtggcccgccacttggccagggacttggccccgcggtcgccgcgccactgcgtgatgcagcgcgaggcctgccagggcacgatcgcgtccacgccggtctcggtcatcgtctcgacggccagctcgccccggtcccccttgggaagggcctggaccaccgtgatccggacctccggctccggctcctcctcgatggcgttcaggtccatgacgaccagccggtccttgccctcggcggccttgaccacgccctccgaccagtggccgcgcccgtccgtgaggaccacgtcctcacccgggttcagccgtttcacggagacggcgtgccggccctccgcgccgtccaggacgaactccggtcccgcggggacctcttccaccacgaacaccggggcggtcatgacgcactcctcatctgcattgccttcaacgtgctctgtgcctcggccagttcggccgccagcacctccaccagttcccccgccggcagcggccgcgccagccggtgcccctggccagcccacagggccatgccctgcgggtccccggccgcggcggcggctttgcgcagccccgaggtcaggtggtggacctgcgggtacgcggccggggcgtacggcccgtgctcgcgcatgaagcggttcaccagcccgcgcgccggccgcccggagaaggcccgggtcagctcggtgcggacgaacagcgggtccgtcagcgccttcttgtgcaccgggtccgcgccggactccgggcaggccaggaaggccgtcccgagctgcgccgactccgcgccggccgccagcagggccgcgatctgcgcgccccgcatgacgccgcccgccgcgatgatcgggagcgccacggcctcccgtacctgcgcgaccagcgcgagcaggcccacggccgccgtgccgtcgatctgcgggtcgtcccggtgggtgccctggtgaccgccggcctcggtgccctgcacgcagaccgcgtcggcgcccgcgtgctgggcgctgcgggcctcctcggcggaggtcaccgtgacgacggtgtacgtaccggccttgcgcagagcggcgagggccgcgaaggcgggacagccgaaggtgaacgagaccaccgggaccgggtcttcgaggaggatggcgagtttggcgtcgtagccgtcgtcgctggtgccgatgatgtcctcctcggccagcgagatcgcgtaccagctcgcctcgccggccagctgcccccggtaggcctccacggcggccggatcgacgtaaccggtctgcggcatgaagaggttgacgccgaaacggcgccgggtcagcgcgcgcacctgcttgatctcctggtacatcccgtcggcggtcttgtagccgccggccaggaagcccagcccgcccgcctcgcacacggcggcggcgagggcgggacaggaggcgccgcccgccatgggagcctgcacgatcgggtacggggagagaccgttcggcgcggaggacatggactgcatcgtgccacgtcccgcgcggggggccgaatcatcgcattcgcctggcatagtccgcttcccgaccggcctgcgggccgccgccggaccatgcgacgagcccggcccggggaatccccgggccgggctcgtgacagtgcgtacgggtcggtcagcggccgttgaacgcgtccttcagccggctgaacagaccctgctgacccggcgcgaactggcccatcggccgctcctcgccgcgcagcttcgccagctggcggagcaggtcctcctgctgggcgtccagcttgcccggggtggtgacctcgacgtgcacgatcaggtcgccgcgtccgccaccgcgcaggtgggtgacgccccggccgtgcagcgggatcgcctggccggacccggtgccgggccggatgtcgatctcctccagcccgtccagcgtctccagcgggcacttggtgcccagcgcggccgccgtcatcgggatggtgaccgtgcagtgcaagtcgtccccgcgccgctggaaggtcgggtgcgccagctcgtggatctccacgtacaggtcgccggcggggccgccgccggggccgacctcgccctcgcccgcgagctggatccgggtgccgttctcgacacccgccgggatcttgaccgtgaggctgcggcgggagcggacccggccgtcgcccgcgcactcgtggcacggggtcgggaccacggtgccgaagccctggcactgcgggcaggggcgcgaggtcatgacctggcccaggaaggaccgggtgacctgcgagacctcaccgcggccgcggcacatgtcacacgtctgcgccgaggtgccgggagcggcgccctcaccggagcaggtgttgcagacgacggccgtgtcgacctggatgtccttggtggtcccgaaggccgcctcgtccagctccaggtcgagacggatcatcgcgtcctggccgcgccgggtccgcgagcgcgggccgcgctgcgaggcctggccgaagaaggcgtccatgatgtcggagaagttgccgaagccacccgctccgaagccgcccgctccgccaccgccgcccgaggaggacagcgggtcgccgccgaggtcgtagacctgcttcttctgcgggtccgagagcacctcgtaggccgcgttgatctccttgaagcgctcctgcgtcttcgggtccggattcacatccgggtggagttcacgcgcgaggcgccggaaggccttcttgatctcgtcctgcgatgcgtcgcggcgcacgccgagaacggcgtagtagtccgtggccacttacgactccgccaggatctgtccgacgtaacgtgccactgcgcgtaccgctcccatcgttccggggtagtccatgcgggtcggtccgaccacgccgagtttggcgactgcttcgccgcccgaaccgtaaccgaccgagacgaccgacgtggagttcagtccctcgtaggcgttctcatgcccgatccgtacggccattcccgactcgttggcctcgcccagcagcttgaggagcacgacctgctcctccagcgcttcgagcaccggcctgatcgtcaggggaaaatcgtgtccgaagcgggtgagattggcggtgccgccgatcatcagccgctcttcggcttcctcgaccagggtttcgaggagtgtcgcgagcaccgtggagaccgtgccgcggtcctcggcctcgaaggattcggggaggtcctggacgagcggcggcacatcggtgaagcgccgcccgacgacccggctgttgagccgggcccgcagatcggcgagggacgtctcgccgaaggggctcgggcagtcgatgagccgctgctcgacccgtccggtgtccgtgatcagtacgagcatcaggcgcgcgggagcgagcgagagcagctccacgtgccggacggtcgagcgggtcaggctcgggtactggacgacggcgacctgccgggtgagctgcgcgagcagccgcaccgtacggccgacgacgtcgtcgaggtccacggcgccgtcgaggaagttctggatggcccggcgctcgggcgacgacagcggtttgacccccgccagcttgtcgacgaagaggcggtagcccttgtcggtggggatccggccggcactggtgtggggctgggcgatgtagccctcctcctccagcacggccatgtcgttgcgcacggtggcgggcgagacgccgagccggtgccgctccgtgagcgccttggagccgaccggctcctccgtcccgacgtagtcctggacgatggcgcgcagcacttcgagtctgcgttcgctgagcatcgcgcacacctccagctgtggtccgttgccgtgttctgccgtgtctgccgtgttctggcacgtggtctggcactctgatcgttcgagtgccagagagcccccgctcagtgtacggccgggcggtaagcccctggcaagggaggcccgccagggtagcgtcgccgtatggacgtgcgttgggaagggtcgggctgggaacggctgacgggacgggccggccggcggcgcctgccggtgtgggactgcaccgtggggctggtggtgggcgaggattcggtccttctgatcgaccccggttcgtgtctgcgcgagggcgccgaggtccgggccgaggcggagcggctgacgggtcggcgcgtgacccatatcgcattcacgcacggtcatttcgatcacgtgctcggcggggcggccttcgccggggccgaggtgttcggggcggtcgggctcgccgcactgctgtcggcggaacgcgaggagctgcgcgaggacgccgtgaagcacgggctcgcggaggccgaggcggcggaggcggtggaccagctggtgctgccccggcacgaggtgtcgggcgagtggacgctggaactgggcggcgtacaggtgctgctggccaatgtggggcccgggcacagcgggcacgacctggccgtcttcgtcccgggcgaacgcgaggtggtcttctgcggggacctggtcgaggagtcgggtgagcccatggcgggcccggacgccacgcccgcgcggtggcccgcggccctggaccggctgctgtcgctgggcggggacgacgcactgtacgtgccgggtcacggagcggtggtcggcgcggacttcgtccgtgcgcaacgcgccacactggcggcccgtttcggcgtgtcggaggcgtgacgcgcgcggctctcctactgtcggccggatgcgcgagtactcccccgacctgaccccgcagtggaagcgccccaaggccgtgccggaggtggcggcggaccccgacctggtggtcgaggtggcgggtacggacttctgcggcgcggtggtggcctgcgaggcgggcacggtgaccctggaggaccgcttcggcaagcgccgggtgttcccgatggagccgcgcgggttcctgctggacggcgcggtggtcaccctggtccgtccgccccggggcccggcggcgccggcccgtacggcgtcggggtcgctcgccgtccccggggcgcgggcgcgggtggcgcgggccggccggatctacgtcgagggccggcacgacgcggagctggtcgaacgggtctggggcgacgacctgcggatcgagggcgtggtggtggagtacctggagggcatcgacgacctcccggccgtcgtcgccggcttcggcccggccgcggacgcccgcctcggcatcctggtcgaccacctcgtgccgggctcgaaggagtcccgtatcgcggcgtcggtgacctcgccggacgtgctgatcgtgggccacccgtacgtggacgtctggcaggcggtgaagccgtccgcactgggcatcccggcgtggccggtgatcccgccgggccaggactggaagacgggcgtctgccgggcgctgggctggccggagaacaccggcgccgcctggcagcacatcctgtcccgggtgacgtcctacaaggacctggagccggtcctgctgggccgcgtggaggagctgatcgacttcgtcacggcgccggcctgaactacggcagggtgccgaactccgcggtatcgagggtgaggccgaggacatcgagcgggaccggttcaccgaacttgctggtccgctcggttcggtagtcggcctcttctcccgcgccaaagggttcggtgagcacgacgcacttggcctggaacgggtcaatgatcaagtacgttgggatgccgccggccgcgtagatcgagcgcttcgtcacgtagtcgcgcagcttgctggtcttggagacgacctccaccaccatcgccagggccgaggcgggcaccaggcggcccgactccggcgctgcctcggccggcaggaccacgaggtccggctgcggctcggacgactctgcaggaatgtccacgtcctgggtctggagcggataccagcgtcccaccgggacctgccgctggacgaacaggacgatcaggttgtggacgacgtccggccccgccatcatcacgatttcccccctgaggagctcgaccttgaccccctcgggagcctcgaagctctcgaagtactcggtcatccggcgatcgtccacagcggtcatctccgtgccctccacttctgccgccgggcattgcggcagaagactatgaacaggctaggcggcacctgccctgatccgcagcaattcactccgtggagtgatcagtccaccaggtcccggaccaccgcgtcggccagcagccgcccgcgcagggtcaggacggcccggcccgcctcgtacgggccgggggccaggaggccgtccgcgagggccttgcgggacgccgtgaggccggccggggcgagcagggacagcgggacgccgtccacgaggcgcagctccagcaggatccgctcgacccggcggtcctcctccgagaggagctcgcgtccggcgccgggggatcggccctccgcgagcgcggcggcgtacgcgcccgggtgcttcacgttccaccaccgcaccccgcccacgtgcgagtgcgcgccgggcccggcgccccaccagtcggcgccgcgccagtacagctcgttgtgcaggcagcgtccggcctccgaggtggcccagttcgacacctcgtaccaggagtagccggcctgggccatgacctcgtcggcgatcaggtagcggtcggcgtggacgtcgtcgtcggtcatggggacctcgcctcggcggatccggcgcgccagctgcgtgccctcctcgacgatcagcgcgtaggcgctgatgtggtccggcccggcccccagcgccgccgagagcgtcgcgcgccagtcctcgtcggactcccccggggtgccgtagatcaggtcgaggttgacgtgctcgaagcccgccgcccgcgcctccgcgacgcacgcctcggggcgccccggcgtgtgggtgcggtcgagcaccttcaggacgtgctgcttggcgctctgcatgccgaaggagacccggttgaagcctccggcgcgcagctcggccaggtatgccgggtccacggactccggattggcctccgtggtgatctcggcgtcctcggccaggccgaactcgtcccggatcgccgcgagcatgcgtacgaggtcggcggcgggcagcagcgtgggcgtgccgccgccgacgaagacggtccggacctgccgcgggtcgtccccgagcaccttccgcgccagcctgacctcgtcgatcagggtgtcggcgtagttctcccgggaggcgagcacaccgccggtgccccgcagctcggtggccgtgtaggtgttgaagtcgcagtacccgcagcgcgtggcgcagtacgggacgtgcaggtagaacccgagcggccgctcctccgcgcccgccagggcatgcgacggcagcgagccgtcttcgggcatgggttcaccgtcggggagtgcggaaggcatacccccatcatcccgcaccgggccgggcgctcccgccgacctcgcatccggccccgccggcgtttgaggcgcggggtccggggcggagccccgggagccggtcgcagccgagacacggggccgcccgggaacggcggggtcggcggggcgggccaccgcccggccccgcctggcccgccgcaggcgctacgcctcgcgggacccctcgtacatctcctcgatcaggtgcttgaactcacgctcgaccaccggtcgcttcagcttcaggctgggcgtgaggtcgccgtgctcgacgtcgaggtcgcgcggcagcagccggaacttcttgaccgtctgccagcgctgcaggccctcgttcagggtctgtacgtacgtctcgatcaggcggttggtctccggcgccgccaggacctgctggtacgtcttgccctccagcccgttctcggccgcccagaccaggatcgacggctcgtcgagggcgatcagcgcggagcagaagttacggtcggcgccgtgcacgacgatcgtcgacacgtacgggcagatcgccttgaactggccctcgatctcggccggggcgacgtacttgccgcccgaggtcttgatcaggtccttcttgcggtcggtgatgcgcaggtagccgtcggccgacagctctccgatgtcgcccgtgtgcagccagccgtcggactccaggacctcggcggtcttgtccggctgccggtggtagccctgcatgatgccggggccgcgcagcagcacctcgccgtcgtcggcgatgcggacctcggtgccggggagcggcttgccgaccgtgccggtgcggtaggcctcgcccgggttgacgaaggaggccgcgctggactcggtcaggccgtagccctccaggatgtggacgcccgcgccggagaagaagaagccgatctcgggggccagggcggaggcgccggagacggcggcccgcagcttcccgccgaaggcctcgcggagcttggagtagacgagcgcgtcggcgatcttgtgcttggtggtgaggccgaagggggcggtcgcctggccggtgcggcggaagttgtcctgcgtgaccttggcgtactcgcgggcgacgccgaccgaccactggaagatcttgtacttggctccgccggcggcccgggccttggcggccacgccgttgtagaccttctcgaagatgcgcgggacggcggccatgtaggtcggctgcacgatcggcaggttctcgatgatcttgtcgatccggccgtcgacggcggtcacgtgcccggcctcgatctgcccggaggtcagcaccttgccgaagacgtgggccagcggcagccacaggtactggacgtcctccttgccgatcagcccggtggcgaccatggccttggccatgtacgaccagttgtcgtgcggcagccggacgcccttgggacggccggtggtgccggaggtgtagatgagggtggcgagctggtcggaggtgatggccgcgacccgctccttgaccgccgcggggtgcttggcgaggtactccttgccacgctcctccagctcggcgagggagagcacccagccctcggggtcgccctcggcggcgaccgcgtcggcggcgtccaggaccacgacgtgggcgagcctgggcagctcggcgcggcgctcgcgcgccttcgccagctgctgcgcgtcctcggcgatgagcacccggctctcggagtccgagaggatgaacgccgactcgtccgcgttggtgctggggtagatcgtggtgaccgcgccgccggcgcacatcacgccgaggtcggagaggatccagtcgacccgggtgttggaggcgagcgcgacgcgctcctccgtttccaggccgagggcgatcagcccgccggcgatggcgaacacccgctcggccgcctggccccagctgagtgatttccagtcgtcggcgccgctccggccgtcggccgccggcaccgggtaccggtaggcctcgtcgtcgggcgtcgctgcgacgcgctcaaggaagagcaccgccacggtgggcgggcggttctcgagataggtctgtgtgtcgctcacgacatcctccggaccgatccacgcggtagtgcgtgggcgtggggcgctggggggcgctggggactggcgggtttggcagcctttgactttttaaactggcgagtaaccgtcgagcagtgatcagactagagcgcgaccggcgtgcgcgtaagggcccgcgagcggccgcttcataacgaaacaggcccccgcacctgagtgcgggggcctgctcgcgtcgggtgacggcggggctgctacttcttcttgccgccggactcgtcactggagaggacggcgatgaaggcctcctgcgggacctccacggagccgaccatcttcatccgcttcttgccttccttctgcttctccagcagcttccgcttacgggagatgtcaccgccgtagcacttggcgaggacgtccttgcggatggcgcggatggtctcgcgggcgatgacgcgggagccgatggcggcctggatcggcacctcgaaggcctgccgcgggatgagctcgcgcagcttggcgacgaggcgcacgccgtaggcgtaggcggcgtccttgtgcgtgacggcggagaaggcgtcgaccttgtcgccgtgcagcaggatgtcgaccttgacgaggctgccggactgctcgcccgtgggctcgtagtccagggaggcgtaaccgcgcgtcttggacttcagctggtcgaagaagtcgaagacgatctccgcgagcgggagggtgtagcggatctcgacccggtcctcggagaggtagtccatgccgaggagggtgccgcggcgctgctggcacagctccatgatcgcgccgatgaactcggtgggcgcgaggacggtggcccggacgaccggctcgaacacgtccgagatcttgccctcggggaactcgctcgggttggtgacggtgacttccttgccgtcctccatgaccacccggtagaccacgttgggcgcggtggcgatgaggtcgaggccgaactcgcgctccaggcgctcgcggaccacgtccaggtggagcaggccgaggaagccgacgcggaagccgaagccgagcgccgccgaggtctccggctcgtagacgagcgcggcgtcgttgagctggagcttgtccagggcctcgcgcaggtccgggtagtccgagccgtcgagcgggtagaggccggagaagaccatcggccgcgggtccttgtagccgccgagggcctcggtcgcaccgttgtgcaggctggtgatggtgtcaccgaccttggactgacggacgtccttcacgccggtgatgatgtagcccacctcgccgacgccgatgccgtcggagggggtcatctccggggaggagacaccgatctccagcagctcgtgggtggcgccggtggacatcatccggatgcgctcgcgcttgttcagctggccgtcgaccacacggacgtacgtgacgacgccgcggtacgagtcgtagacggagtcgaagatcatggcgcgggccggggcgtccttgacgccgaccggggccgggaccgtggcgacgaccttgtcgagcagcgcctcgacgccgagaccggtcttcgccgagacgcgcagcacgtcctcgggctggcagccgatcaggttcgcgagttcctcggcgaacttctccggctgggcggccggcaggtcgatcttgttcaggacggggacgatcgcgaggtcgttctccatcgccaggtacaggttggcgagggtctgcgcctcgatgccctgggcggcgtccaccaggaggacggtgccctcgcaggcggcgagggagcgcgagacctcgtaggtgaagtcgacgtgcccgggggtgtcgatcatgttgaggatgtgggtgttgccctgaccctcgcccgtggtgggcgcccagggcagccggaccgcctgggacttgatcgtgatgcctcgctcacgctcgatgtccatgcggtcgaggtactgggcgcgcatctgccgctggtcgaccacaccggtgatctggagcatccggtcggcaagggtcgacttgccgtggtcgatgtgcgcgatgatgcagaagttgcggatcagcgccgagtcggtacggctcggctcgggcacgtggctggggatcgcgggcacgcagtgtcctgattctcggtcgcagtcggaagcgtttgcggagcgtcggtcggagcgaaagtccggctcccgtcgctctcggcggcgcgatgtcggatctatacgcagactcccatggtcccatggacggggcagtgcgctcggtttgggccgcccctagcgtgcctggtagcctgggcagctgtgtctcgtatgccctctcagctgtcgggacacaatccgaagatcaaactctgaacctgaaaaggctctttcgtggcgaacatcaagtcccagatcaagcggaacaagacgaacgagaaggcgcgcctgcgcaacaaggccgtcaagtcctcgctcaagaccgcgatccgcaaggcccgcgaggccgtcctcgccggtgacgtcgagaaggccaccgtggcttctcgcgctgccgcgcgtgcgctcgacaaggctgtctcgaagggtgtcatccacaagaacgccgccgccaacaagaagtcggcgctggccaccaaggttgcctccctgcagggctgagctccctgatgtgatcgccggaagggacccagtgggccctctctcccgctcctgaccggcaccccgctccgcacacgaagcgttcgccacgcgggtgcggagcaatccagaagtaaccgaaggccccggcctccgcccttccccagggtggtggccggggccttcgtgctgcctggcgggccccggcgcacgggctcggccgtgtggctgtcccggggcggtacgcggcgcggcggcggccggcgccggccgctgcgcgccgcggtacggcttcgctacctgcgctgggggcgggccgcgctggccaccgccaccacggccttctccagggcgtactcgggatcgtctccgccgcccttgaccccggcgtcggcgtcggccacggcgcgcagggcgtccgagaccgcgtccgccgaccagccgcgcatctgctggcggacccggtcgatcttccagggcggcatgcccaggtcccgggcgaggtcgccggggcgggccccgcggggggcggaggcgagcttgccgatcgcccggaccgcctgcgccagggcgctggtgatcaggaccggcgccaccccggtggccagggaccagcgcagggcctccagggcctcggccgcccgcccctcgaccgccctgtcggcgaccgtgaagctggaggcctcggcccggcccgtgtagtagcgggcgacgacggcttcgtcgatggtgccctcgacgtcggcgcacaactgcgcggccgcgctcgccagctcccgcaggtcgctgccgatggcgtccaccaggttctggcaggcctccggggtcgccgagcggccgagcgtgcggaattcgccgcgaacgaaggacagccggtcggcggccttcgtcatcttcgggcaggcgatctcccgggcgcccgccttgcgcgcggcgtccagcaggcccttgcccttgacgccgcccgcgtgcaggaggaccaggatgatctcctcgtagggcgcggcgaggtaggccttgacctccttgacggagtcggcggacaggtcctgcgcgccccgcacgatcaggaccttgcgctcggagaagagcgaggggctcgtcagctcggcgagcgtgccgggctggagctgctcggaggcgagatcgcggacgtccgtgtcggcgtcggcggcacgggcggccgccaccacctcgcgcacggcgcggtcgagcagcagctcctcctgccccaccgcgagggtgagcggggcaagcggatcgtcggtggagttcttcctggtggccatcggctccagcatcccacgccgcaccgacagccccccgccccgcgtgcccgagaatggtcgcgtgaatgtgcgacatgtactcgtcctgcccgaccgcgacgccgccgaggaggtggcccaggaggccgtcgaccgcttcggcctcccggaggaaccgcagttggtccgcgacgcgctcgccggcgaggacgacgccgaggacgcccagtggctggtggtcgtcgaggatccgcaggaacggctcgacagcacctcgctggacgacctcgccgccgagtacgagggctggctggaagccccgtagggggcctccgcccgcgcacctcaggccttgcgcacggcctggacgtccagggtcacttccacgctcgaaccgatggccgcgatcccctgcgccagcatcgactgccagttgagggtgaagtcctcgcggtgcagctcggtggtggcccggcaggccgcccggagctcgccctccaggcccgtgcccagaccgaggtactcggtgtccagggtcacggaccggctcacgccgtggagcgtgagcgccccggcgacggtccagcggccgccgctgcggtggatgaaccgctcgctgtagaactcgaccgtggggtggcggaccgcgtccaggaagtccgccgacctcaggtggtcgtcgcgcatccgcaccccggtgtcgatgctcgccgcgtcgatgatcacgtgcatggaggagtcctccatgcgctcggctatccgcaccgccccggcgaacgtggtgaaccggccgcggatccgggccaggccgatatggcgggccgtgaagccgatggtcgagtgggtcgggtcgagctcccagtggccgggctgcggcagcagcggcggctccaccgcgtccaggacgatctcggcggtaccgggctgcgccgggtcccccacgatcgtcaccccgtggaagggcgcgtagccctcggcggtcacggagagccggtactccccctccggcacggccgcggtgaagccgccgtacggatcggtctcgccgctgacgatccgacggccgatcgggtcggtcacctcgaacgtcgcctgccggagcgggcggtggaccgtgtcgaggacccggcagctgagcagacgcgccgtcggcggcagcgtcagtgtcgcggatgtggacgggccggaacttccggcagtcccggccgtctccatcccccgtctgcgactgaacatgactgatgcacccccgtgctgtgtggacttggaccagtctggcgaagacgcattcgatcatgctgtcgggttgtgggcaaacagagtggtcgcgcccggtatggccgcgtcgattccgccgccggatggccggaaatgaccgtagtcgaactccactcccggtgacggcgatcgagccgtccgtgtcggtgcgcagcacggtcgcgcccagctcccgcagccgggcgagcgtacggggcgcggggtgcccgtaccggttgcccgcgccgacgggaacgagcgcgagccgcggccggacccgggcgtagagctccgggtcctggtgcgcggagccgtggtgggcgaccttgaggacgtccaccggaccgaggtccggatgagccctcaggagggcttgctgagcgggcggttcgaggtcgccgagcaggagcagggtcagtccggcgccgcgcaccagcagggcgacgctcgcgtcgttgggcccttcgggcagcggtccggccgacggcggccagagcacctgccatgtgaacggcccggcccggcgccgctccccctgcgccgcccgcacgatcggcacaccggcggccgcggcggtccgccggacgaactcggcctgtcccggcggctcttccagcgcggtggcctggatcacacccacggacctgccccgcagcacccccggcaggcctcccacgtgatcggcgtgaaagtgcgtcagcaggagcagcggcacccgccgcacaccgagggcgcgcaggcactcgtccaccgggccgggctccgggccggcgtccaccaccagggcctcgccggggccgacggcgagcacggccgcgtccccctgcccgacggcgcactggacgtagctccagtcgggcggaggccagccggagagcgtacgggtgagctgcggcggccgcagtacgaccaggagcagcagcgccgccagggcggagcagagccacccccggccgcggaaccgggcgccgccgaccacgacgacggccagggtggcggcggccagcagaacgccgccggtgagcccgcccggccacggcagctccgcgcccgggaaccgggccccggcccgggccacgcccgcgatccacccggccggcacccccgcgcaccgggcgagcagctcggcggcgggcatccacaccggggacaccgcgagcgcggcgaaaccgagcaccgtcgcgggaccggccgccagctcggccagcagattgcacggcaccgccaccaggctgacgcgggcggcgagcacggccaccacgggcgcgcacaccgcctgcgcggccgccgcggcacccagcgcctcggcgagccgcggccccgccccacggcgccgcagggctgcgctccaccggggagcgagggtgagcagcgccccggtggccagcacggagagcaggaagccgtggctgcgggccagccacgggtcgtggagcaccagcagcagcacggccgcgcccagggccgggatcagggacctgcgccgcccggtggcgatggccagcagggtgaccgcgccgcaggcagcggcccgcagcacgctcggctccggccggcacaccaccacgaacgccagcgtcagggccgccccgtacagggcggtcacccggagcgagagcccgagtcggggtgccagcccgcgccgttcggcctgttgcgcgcgggccgggggtccgatgagcaggaacaggaccacggtcaggttggaccccgagacggccagcaggtgcagcaggtcggtggcccggaaggcctcgtgcagatcgggcggaaccctggacgtgtccccgacgaccagccccggcagcagggcccgggcatccgggggaagcccctcggtggcctcgcgcagtccggcccgcagccgccccgcgagccgctggacggtgtccgggccgccggtcaccccgggcggggtgtcaccggccggacggaacagcgccacggcccgctccccgccccgcgccggagccagccgggcgaccaccgtcacccgggtggaaggctgcagcctggcccatcccgggtgcccggccagcacccgcaccggggtctcgacccgggtgctcgacccgtcgggcccggtcacccgggtcaccaccgcgtccagcaccgtcaccggtggtccgctcccgctccgggcggccctggggtcggagccgacggtgagctccgcgaggacgcgggcgtgctcccgcgccagccccgccaccggcccggccctcgcctcggcccgctggagccccgccaccccggctccggcggccgcgcacagcagggccgccgccgcggccggggcgagccgccacaggggtcccgggcgccggcacgcgcccagcatcagcaggcccgcgcaggccatccccaggcccaccccgagggcggtccggtggacgggcgcgtccagggcgagggcggccgccgcccaggcggccacggcgggcaccgcgaggcggaggtccggcgggaccggacccaccgggcggttcacggccgcaccagcttgcgcaggtcggcgaagcgccgctcaccgatgccgacgacctggcggagctcctccacggagcggaagccgccgcgggcggtgcggaaatcgacgatgtgctgcgccagcaccggcccgacgccgggcaggccgtcgagctgggcgaccgtggccgaccccagactcagcgggccggaaccagggcccgagccggagccggacccggagccggaggccgagccggcaccgccgcccggcccggccggtggcggctgcgccggcgcgccgaccaccacctgctcgccgtcgaccagcacgcgggcccggttcagcccggtcgtgtcggtgccgggaggcactcccccggcggcggccaaggcgtcctccacccgcgaaccggcgggcagccgccgcaccccgggatcccggaccttgccgctgacgtcgacgacgatccgcgcggccgctccggcttccacccccgcggccggaactccggccgccggtgccgtggcagccgccggtacggcccccggggcgaccaccgcgggcacggtcaccgcgcgcggccgggccgaccagtactgctgcccggcgagaccgacggcggcgagcagcaccaccccgacggcggccaccgcacgcggccgcacctcgcagcggtcctgcagccacagcggcagacgctcccgcacggccgccctcctcgcggcccctgaggacagcccggacggctcatcgggcggtgcctgggcatccagcccctccggggccgcgggcggcgcctggacggcgcggggtggcgggggcgggggcggggcctgcggcgggctgctgccgcccagcagcgcctcggcccgtcggcgcaccacgcccgcatccggatggggaacccgtcggccacgagccgtccgacgatgccggcgccggctgtcggaaagccgaccgtcggaggaacggctgtcggaaagccggccgtcggagagacgggaacggcccgggccactggtggcgcccgacggatgcgaagcacgcgctcgaagattcatgccacgaccgtaggggccgatccgcgcccccgttcggaacactcaattccagtggaaaaaaagatcgttgtggataacccagccactcgttccggtgagggcggcgtgttcagcggggcgagacgaccgccgccagcagccccgggccggtgtgtgccccgatcaccgcaccgacctcgctgacgtgcagctcgaccagtccggggatgcgctcgcggagccgctcggcgagcttctccgcccgctccggagccgccaggtggtgcaccgccacgtccacgtcggcggacccggcgcgttcgacggccagctcctccaggcgggcgatggccttggaggacgtacggaccttctccagcatctcgatccgcccgccgtccagcgtgagcaggggcttcaccgccagggcggagccgaggagggcctgggccgccccgatccggccgccgcggcggaggtagtcgagggtgtcgacgtagaagtacgcggccatgtccgccgcccgcttctcggcggccgccacggcctcgtccacggatccgcccgcctcggccacctcggcggcggcgagcgcgcagaaaccgagggccatcgcgaccatgcccgtgtccaggacacggaccggtacgggtgcggtcctggcggcgaccacggccgcgtcgtaggtgccggagaactcggcggacaggtgcaggctgacgatgccggtcgcgccggcgtccgccgcggcccggtaggcccggacgaactcctccgtgctggggcgggaggtggtgaccgagcggcgcttctgcagggcaagggccaggctgcgcgccgagatctcggtgccttcctcaagggcctcaccaccgagcaccacggtgagcgggacggcggtgattccgtgccgcgccatggccggtcggggcagataggccgtggaatcggtgacgatggcgacatggcgggacatgagccggaggttaccgccagtggggcctcgacggcagcctgggcccccgacccgggcggggtggggtccgggcgtaccgctgccgcggtggtggccagagcctacggagcgcgcgggggccgggtcccggcgggcccgggtcccggcgggggtgtcagccggcgctctccgggcgcggggccttctgccacgggtactgcaccgtcggagtcggcgggttcaaggcggccggcggggccgtgggggtcggcttcggcgccggtgcagccggtgcagcgggtgcggccggtgcggagtgggcggacggcgcggactgcgcggcgtcccactcggcggccgcggccgccaggtcgtccgccggttcgcgggaccagtcgcgcagcgcgcccgactccatctcgatctgctccgacaagagggacaggtcgtccgccgcgaaccgcctggcccggtcacgggccgcccaccgcagggagtcggcggccttgatgatctgtgccgcgcgctcgcgcaggtccgggaggagctcggcggtgcgccgccggtcgggctcctgctccagccgcttcagctcaccgtcgagctcgtgcccgtgcgcgctcagctgctcgaacagccccagggactcccgcagcgaggcatccgcccggaccccgtcggccagcgcctgctgggtggcgcgcatcgaggtccgcaggtccagccgcacctgtgccagcgcccccaccactccgacctggccgaagctcttggcccgcagcgtggtgtcctcgaccgtgcgccgcgcctgcacgaccgtgcgctccacgccccgcttggccgctcccaccgccttgaccgtgaggtacgcgccgaggccgacgaaagccagcagcatcagcgcgaaaatgatcaacgcgacctccatgacggcccctttccccaagcgtcgctcttctcctccacggtaaacgccacgggcaggccaggggttccaatcgaacccccaacctgcccgtacgggatcacccccatgcgggggcgcgctctcagatgacgatgttcaccagcttcggcgcgcgcacgatcaccttgcggatctccgcgccgcccagcgccgccacgacaccctcatcggtcacggccagctgctccagctccgcctcggagatcgtcggcgacacctccagccgcgccttgaccttgcccttgacctgcaccacgcacgtcacgctctcgtccacgacgtacgccgggtccgcgaccgggaagtcctggtggaccacggactcgctgtgacccaggcggtgccacagctcctccgcgatgtgcggggccaggggggcgaccagcagcaccagggcctcggcgaccgagcgctccagcgggcggccggccttcgtcagggcgttgttcagctcggtgatcttcgcgatggcggtgttgaagcgcagcccggtcaggtccgagccggccccgtcgatcgccttgtgcagcgcgcgcagggtgtcctcgcccggctcgccgtcgacgacggtgaccgcgccggtctcctcgtccacgatgttgcgccacaggcgctgcagcagccggtactggcccaccacggcccgggtgtcccacggacgggagacgtccagcgggcccatcgccatctcgtacaggcgcagcgtgtccgcgccgtactcctcgcagatctcgtccggcgtgacggcgttcttcagggacttgcccatcttgccgtgctcacgcttgaccggctggtcctggtagaagtagccgccgtcgcgctcctcgacctcggccgcgggcacgtagacaccgcgcgcgtcggtgtacgcgtacgcctggatcatgccctggttgaagagcttgtggaacggctccgccgaggagacgtgccccaggtcgaacagcaccttcgaccagaagcgggcgtacagcaggtgcagcaccgcgtgctcggccccgcccacgtacaggtcgacaccgccgtgcggagcgccctcgcgcggacccatccagtactgctcgatctccgggtccaccagggccgacgcgttgttcgggtccaggtagcgcagctcgtaccagcaggaaccggcccagttgggcatggtgttggtctcgcggcggaaggaacgcacgccccggccgtcgcccaggtccagctccacgttcacccactcgccgttgcgcgacagcggggtctccggcttggacgtggcgtcgtccggctcgaaggtgcgcggggagtagtcctcgacctccggcagctccaggggcagcatcgactcgggcagcgagtgcgcgacgccgtcctcgtcgtagacgatcgggaagggctcgccccagtagcgctgacggctgaacagccagtcgcgcagccggaagttgaccgtcccctcgccgatgccgcgctcggtcagccagtcggtgatcgcggccttcgcctcgacgacgcccaggccgtccagggcgatgccctcgcccgtcgagttgaccagcttcgcgtcgtaggagacgaaggcgtcgtcccactcggccgggtcggtgccgcgcccgtccgacggctccacgacgcagcgcatcggcagctcgaaggcgcgcgcgaactcgaagtcgcgtccgtcgtgcgccgggacggccatgatcgcgccggtgccgtagcccatcagcacgtagtccgcgatgaagaccgggaccttgtcaccgctgaccgggttgatcgcgtactcgccggtgaagacaccggtcttgtccttggcctcggcctgccgctcgacgtccgacttcgaggcggcctgcttgcggtaggccgcgacggcctccgccggggtggcgtgcccgccggtccacacgtcgtgggtgccctcgggccaggcggccgggatgaacttctcgaccagcgggtgctcgggcgccagcaccatgtaggtggcgccgaacagcgtgtccggacgggtggtgaagacggtgatggcctcgtcgcccagcgcgaagtcgacgcgcgcgccctcgctgcggccgatccagttccgctgctgcagcttgatggcctcgggccagtccagcgcgtccaggtcgtcgatcagccggtcggcgtaggcggtgatccgcatgttccactggctcagccgggacttgaagaccgggaagttgccgcgctcggaccggccgtccgcggtgacctcctcgttggccagtacggtgcccagcccggggcaccagttcaccggcgcgtccgaggagtacgccaggcggtactcgttcagtacgtcggcgcgctccgccgcggtcagctcggaccaggcgcggccgccggggacctcacgggagccgtcctcgaaggcggcgaccagctcggtgatcggccgggccttcttcgcgtccgcgtcgtaccaggagttgtagatctgcaggaagatccactgggtccacttgtagtagtccgggtcgatcgtggcgaacgagcggcgcttgtcgtggcccaggcccagccggcgcagctggaccttcatgttctcgatgttggcctcggtcgagacccgcgggtgcgtaccggtctgcacggcgtactgctcggccggcaggccgaaggcgtcgaagcccagggtgtgcaggacgttgtggccggtcatccgctggtggcgggcgaagacgtcggtggcgatgtagccgagcgggtgtccgacgtgcaggcccgcaccggaggggtacgggaacatgtccatgatgaacttcttgggccgtgcgaccactgcggggtccccggccaggtcaccggtcgggttcggggcctcgtacgtgccctgcgcgtcccagacgtcctgccagcgtgcctcgatgtcggcggccatggcagccgtgtagcggtgcgcctcggccgcctcgggggccggggtgttcgtctcgctcatgatttctgaagctccatcgatcgtctctgccgtctctgcctgcccaaacgaaaaaacccctcgcacaggagggggcgccgcgccgggtccgaccgtctcgaagggtcggcactgatcagcgcggctcggtaagcagaaggcgtacggcacgcatggcgtcagggtaccgcagcggcccgttccgacgctcggccgttccacccgtcgacacggagacacgtggagacggggagacggggagacgggagacgcggagacgggagacgggcacagggcccgaggcgcgcggggcacaacgagaagcgggccacccgatccgggtggcccgcttcttcactgtggagctaaggagaattgaactcctgacctcctgcatgccatgcaggcgctctaccaactgagctatagccccttgttgtgcttgccgcttcggtttcccttgccggttccccttggcgacatcccaaacattacacggtcatggccctggtccaaaaatcggtttccacccaccagagaccatgtccgatttgagccaacttgtcacgctctggcgaactggtagaaccgcttgagcgtgcagtgctcgtcgagcagccgcccgtagatcggctccccttccagctcgcggtacgtctcgatcgggtcgccttttatgatcagcgcccgagcgcattcctcgcaccagtactggtagtcggggttgaccgggtccatgtcccgcacgatcggcgtgccgttgttgcaccagtcgcaccggcgccggtgtgcacccatccgtcagcgactccctcccgcgtcgggccgtcgtctccccctccggcggtcacgattctgccatgccggtgcgggccaggtcagcaaacgcaaagggtacaaaagcaaggatcccgccccctgttggggacgggatcctgattgtggagctaaggagaattgaactcctgacctcctgcatgccatgcaggcgctctaccaactgagctatagccccgctctccgccgcgctccccccgtctccggtgttctgcgctgcgaacaagaagaactctagcctgtgcccagccggaaagtgaaatccgggtggcagccccgccggggagcggcagaaggccgctcagtcgtcgtcgccgagcaccggttccggcagcgtgccggcgttgtgctccagcagacgccagccgcgcgcgccctcaccgaggacggaccagcagcagttggagaggccgccgaggccctcccacgcgtacgcgtccaggccgagcaggcgcccgatcgtcgtacggatggtgccgccgtggctgaccacgacgagggtgccggacggcggcagccggtcggcgtgttccagcaccaccggcgcggcgcggtcggcgacctcggtctccagctcaccgccgccgcggcggaccggttcgccgcgcttccacgccgcgtactgctcgccgtacttttcgaggatctcgtcgtgcgtgaggccctgccactcaccggcgtacgtctcgcgcaacgcctcgtcgtgcgagacctccagccccgtgacggccgccagctccgccgccgtggcggaggcgcgccgcaggtcggacgccacgatggcatccggcttcagcgaggcgagcaaccgcgcggagcggcgcgcctgcgccacacccgtcgcggtcagctcgatgtccgtggacccctggaagcggcgctccaggttccacgaggtctgaccgtgccgccagaggacgatcttcctgccgggcctgcccgaggtggtcgcgctcagaacagatcaccgtccagttcgtcgtcgcccgccgcctcgcgcagcttggcgtgctcctcggccttgccgatggtgagcttggcgtcctcggggagctcgatctcggggcagtccttccacaggcgctccagcgcgtagaagacacgctcctcgctgtgctggacgtggacgacgatgtcgacgtagtcgagcaggatccagcgggcgtcgcggtcgccctcgcggcgcaccggcttggcgccgagctccttgaggaggcgctcctcgatctcgtcgacgatcgacttgacctggcggtcgttgggcgccgaggcgagcaggaaggcgtcggtgatcgacagcacgtcgctgacgtcgtacgcgataatgtcgtgcgcgagccggtcggccgcggcctgggcggcggcggtgatgagctcgatggagcggtccgtggcggtcactggccatgctttcgggttggcgggcagatccttacaagggtctcatgtaccgccgacaccgcccgcgcgcagcgtcgcgcgcgggcgaaagcctccttcggggccgctccggagcctggtcaggacgccttgtagtccttgcccaggatcaccacgatctccgcgttcaccgcgttctcgcccttcttcacgaccgtctcgggcagcgccagcgtcttggcgacctcgatcgcgcggtcccgctgcgcgtcgtcctggtaggtgatctgcgaggtggccgcggtcttgtcggccttgccgccgtcgacgaaggtgtagccgccgttcaccagcgccgccttcgccacgatctgcgtcttctcgtcgccggtcgcgtccttgaggccgacgcgcggggccgcgccgggctgcgccgcggcgccggagccgccgagcacctccttgacgaccgtcttgttcgcgtcgtccgtgagcgtgccgtccgccttcacggcgaggacgtccgtgcggtacgcgccgaccttggcgtgcgcgccgagcttggacagcagggcgccgagggtctgcgcgttcagggccggatcgaggatctggccgatgctctcgacggtcacggccgccgccttcgggtcgctcggaaccttgcgcagcaccgcctggagcaccttgcccatgcgttccagctgcttggtctccggttcgcccggtccgcggaacgtggcgtacgccacggccatcgggccgctcaggctctgcttctggccctgggccacggcaggggtcttggccgcgtcgtcggccgggaccgcggcgtcggtgtcgacctcgatgccgccgaccagctcgaccaggttctccaggaagggggtgtccaggcgccaggtgccgccgatgcgggtgccgagcacggagtccagggcctcgcgggtgccgagaccgccttcccccacggacttgccgagcacggtcgccgtcccgtcctggccggtgacggacagggtgttcggcagcaggacggtggcgccctgcttggtcgtgacgttgtcgacgagcagcgccgaggaggtgccgcccttcttggtgttgtgcaggtggacgacgatcatgtcccgcttctgcgcgccggcgtcggcggcggcgccggtcttcttgtcgccggggccgtcgaggaagggcagcttgcccgcgtaccagaggtagccgaggccgccgacgacgaacagggcgaggacgacgatcagcgccaccacccggttgcggccgcggcggcgggcctcctcgcggcgttcggtgcggctctcggtgaacttgagccagtcgatgacgtcctcggagtcctcgtccggctggtcgatgaaggcgaacatctcggtgcggtagtcccggcccgcctcgggctccccgtcgtgctcgccgcggcgcgcaccgccctccccgccgtccggccggcgcggctcggggacctgggcggccggccgctcggcgggggccgggggctcctcgggggcgttctgctgcgggatccactgctgggtctgctgcgtgtcgtacccgtgggcgggcgcctgggtgtactcctgctgctggtactcctgcgcggccggctgctgctgctgcgggtagtactgctgctgcggctgggcgtagccctggtagtcgtagccgtactgctggtgctgctcgtactgctgcccgtactgctgcggggcggccggtccgggctgggcgggctgcgcgggcacctggccgtacaccggccgcccgtacgcgtcgtagccgacgagctgctgctcctgggcggcatacgggtcgtacggatcctgtcggtcgttcaccgcggggcccctctctccggaagctcaggctccccggtacagctcacgcttgtcgatgtaacgcacgacaccgtccggcaccaggtaccagacaggatccccctgggccaccctcgcacggcagtcggtggacgagatcgcgagcgccggcacctccaccagggagacgccgccctccgggagcccgtcgtcggtgagcacgtggcccggccgggtgactccgatgaagtgggacagcgagaagagctcttcggcgttgcgccaggtcaggatctgcgcgagcgcgtcggcaccggtgatgaagaacaggtcggcgtcgtcgttctgcgccttcaggtcccgcagggtgtcgatggtgtacgtcggcccgccgcggtcgatgtcgatgcggctcaccgagaactgcgggttcgaggccgtggcgatgaccgtcatcaggtagcggtcctcggccggcgagacggcccgctgcgacttctgccacggctcgccggtcggcacgaacatcacctcgtcgaggtggaaaagggcggccacctcgctggcggccaccaggtgtccgtgatggatcgggtcgaatgtcccgcccatcacgccgagccggcgcttgaccggaccggtaggcatctcctgctctcccatgagcgcagagcctactggcccggcggacgcggcgttcccgacgggttcagcggtcgcggttcagcggtcgcggttcaggcgcgtggtgacccagagcatcaggatcaggatcaggaaggcaccgccgccggtcaggtacgggttcaggctgtcgtggttgccgccgtgctgctcggccccctccgaagcgaggacgaccaggttgtgggcggtggtggagaggctcatcaggcagatacctatcgagtcggggagcgggcggagacttcgctcacatcgtatgcgggtgcctggggcacgctcacgccgactcaggcgttggagaggatagacgcagggtcgatcaggtccatacaggggagggcgttatgacggacacagggttcgagaaggcaccggcacgggaccgcaggcggttccccggtatctcgtcgcgggcgtacgagcatccggcggaccgctcggcgctggtggcgctgcgcaagctgagcggcttcgacacggtgttcaaggccctgagcgggctgctgccggagcggagcctgcggctgctgttcctgtcggagtcggtgcgggtgggcgagacgcagttcccgcacctgcacgcgatgctgcgcgacgcctgctacatcctggacctggagaaggtcccgcagatgtacgtccagcaggacccgaaccccaacgcgatgtgcatcgggctggacgagccgatcatcgtggtgaccaccggcctcgtcgagctgctcgacgaggaggagatgcgggcggtggtgggccacgaggtgggccacgcactgtcggggcacgccgtgtaccgcacgatcctgctgttcctgaccaacctggcgatgaaggtcgcgtggatcccgctgggcaatgtggcgatcatgacgatcgtgaccgcgctgcgggagtggttccgcaagtcggagctctcggccgaccgggccgggctgctggtgggacaggacgtgcaggcctcgatgcggggactgatgaagatcgcgggcggcaaccacctccacgagatgaacgtggacgccttcctggcccaggccgaggagtacgagtcgagcggcgatctgcgcgactccgtgctgaagatcctcaacctgctgccgcggacgcaccccttcaccacggtgcgggcggccgagctgaagaagtgggcggagagccgcgaccaccagcggatcatggacggccactacccgcggcgcgacgaggacaaggacacctcggtgaccgactccttccggcagtccgccgcccactacgccgactccgtgcgcaccagcaaggacccgctgatgaagctggtgggcgacatcgcgggcggcgcgggagacctgggcggcaagctccgcgacaagttcacgggcgccgcggccggcaccgcgccgcaggacaagggcgggcctacggagcagcagggctgacgggagcggcccgcgggggcgcggccggagtcacgggcgggttcgcggacgacgtcgcgggcggggccaggacgccgcacagtccggccgtgcgccgcggtcggccgctggcgtacgggtcgctcgcggccgggcccaccgtggtcgggccggctccggccaggagcgggcggaaggctccggccgggtcggccgagcagtcctggggcccggccatcacgtaggccgaggccagctccagccgccgggccgtgaggtcctcccggtcgaagcgcagccgcagctcgcgccggacggtgaagagcgaggcgccgtcggccgcggccggggatccggtggcggggcgtacggcgtagacgaaggtgtggtcggcggtgacctccagcatgtccggggccacctcctcgaaggagaacgcgccgctcacccggacccgggagtcggccacgacggcggtggcctggtcgaagcggaccagccagccggtggccgcgtggcgtccgtcgccggagggggtggtcatgctgcggtcgaactgcgccagctggtcggggtcgagcaggacgcgcaccgggcgggaggccgctccggcgaggatgtcggggtccagcgaggactgcaccaggtagtccttggcgatggacagcgcggcgacgacctgggcctcggtgaagtggtgggtacggcgcacggcgggcaggctgatgccggccgctccgacccggtagtcggccgcggggctcttcgcgatcaggtcggccggcagcccgccggatacggcggtggtcggcgcgagcgggaccacggtgctgctgagcgcctgggcgggtcccccgggcgggggcacataagggttgcgcagccccaggtagacggcggcggcgaaggccgtggcgatgagcagcacgagcagcatgccctgccgggcaccccggccgggggtgctggtccgggccgcggagccgccgccaccggaccagatcgagcggctgcgcaccgcacgggcgtgttcgcccatgcgttcctgcgcggagtactcctggagccgggcagcccggacgaagtcctcgtcgaacaccaccgaccggtactcgtccgaccggaagtcgtccgaccggaagtcgtcatcgcccccgcccatgccctcgggggtgctgttgggtggatctcctggcacggccatcgcttctccccgctgtccccgcttcagagaagcccccggctccggtgtgcgcgagtggggtcgtaccttcagggttggcgaacggaggggtacgtaaacgcgccgacgccggtgacttcgcccctgggggtgctggcgggggccggggcggggtccgcctcgcccgaggcggagcggtagacggcgctgaaggcgagcgcgaccatgccgaggcccatcacgaaggcgagcacccaggccaccgggcgcagccagggtgcgcggccgcggtaggggcgcagactgccgccgtaggccccgtacggcccgtccgggtatccgtagccccggtcgtggtcccagccgtggccgtcgtcgtacccgtcgtggtggccgtacccgtagctgtcgtagtcgtcgtcgcccgtccatccgccggccccggcacgggcggcttcggcctccgcgcgcgctcggtcggccgcccgctggcgctcggcggcgctcggttcatggatctcggcgttccggacgaagtcctcgtcgaacaccacggaggcgaagtcgtgatccgcgcctccgcggtcgtcgtcgggctccccgtcgtccgggaacggcttgccccccacgtcgtccggcacgggaccagcgtagacctggggggcctccttgggcagggtgtgcgccgaatttcggccacaccgcgctcaggaactcactaccgaatgtgaccgtcgcccgtgacgatgtacttggtggaggtcagctcgggaaggcccatcgggcccctggcgtgcagcttctgggtggagatgccgatctccgcgccgaagccgaactggccaccgtccgtgaaccgagtggatgcattcacggcgaccgtggtcgagtcgaccagctgggtgaagcggcgcgcggcggcctgcgaggtggtgacgatcgcctcggtgtggccggaggtccagcggcggatgtgggtgacggcgtcgtcgagggagtccacgactgcggcggcgatgtcgtaggacaggtactcggcggcccagtcctcgtccgtggccggcagggcggtgaccttgccgccctcggcggcggcgaggacccgggcgtcgccgtgcacggtcacgccggcgtcggcgagcgcgtcgagggcgcgcggcaggaaggcgtcggcgatgtcgcggtggacgaggagggtctcggcggcgttgcagacggagggccgctgggccttggagttgatgaggatgtccaccgccatgtccaggtcggcctgcgcgtcgacgtagacgtggcagttgccggtaccggtctcgatgaccgggacggtggactcctcgacgacggtcttgatgagggacgcgccgccgcgcgggatgagcacgtcgacgagaccgcgggcgcgcatcagctcgcggacggagtcacgggactcgccggggacgagctggatcgcgtcggcgggcaggccggcgctctcgacggcgtcgcgcaggatggtgacgagcgcggtgttggaggcgtaggcggaggaggagccccgcaggaggaccgcgttgccggacttgaggcagagggcggcggcgtccacggtgacgttggggcgggcctcgtagatgatgccgacgaccccgagggggacgcggatctgccggatgtcgatgccgttgggcagggtgttgccgcggacgacctcgccgacggggtcgggcagtgcggcgacgtcccgcacgtcggaggcgatggcggcgatgcgctcgggggtgagcgtgaggcggtcgatgacggtctcgctggtgccggcggcgcgggccttgtccgtgtccacggcgttggcggcgacgatctcggccgtacgggcctccagcgcgtccgcgatcgccagcagggcggtgtccttggcggaccgcgggagtggggcgatggccgcggcggctgtacgggccgcctgcgcggtggcgaggacgggcgaggcggtggtggcggtggcggcatcgagcgaggtcatgccgccagggtaagcccctgccggtggccggccgtggggcttccatcccgcgagacggcctccggccgggtcggcggggtggggccggggctccgcccgggcccggacgatcggcaccggaccgtggcgggtgcgggcacacgaccgggggctgcgcccccgaccccgcgcctcgaacgccggcggggccgggaaagccacggctccggcgcgcatgcgggcggggctgggaaagccacggccccggcccgaacgccggcggggccgggcgggccacggctgcggcccggacctgcggatcagtaggggtggacgcctaccgggtgggccgggggtgggccgtagccctccgccacccgctggtggtaggtggcgcggtcgatgacctccaggccgacgatctcccagggcgggagctgcgccgaggagcggtgttcgccccacaggcgcagggcgacggccgccgcgtcgtggaggtcccgggcctcttcccagtagcggatctccgcgtggtcgtcggcgtaccggctggtcagcaggaagggatggtcgtgggccagttgttccagcccgcgccggacctcggacagcggggccggcttgccggagacgctcagggtcacgtgccacaggcgcgacgcgtggtcctgctcctccccgccacctccgccgtcaccgtcccccgtgccgacgctggtcagcgctcgcctcaccagccgcctcctgtctccgccacgcgggtccgcccgcccctcacagttgaccagtccacgggccgccgcgctccgcttttgccgaacctcagccctccagcaggaccagatcgtcccggtggacgacctcccgctcgtacgcgggtccgagttcccgcgcgagctcgcgagtggagcggccgaggagttgcgggagctccttggcgtcgaagttgaccaggccccgcgccacggcgcggccgtcggcggagcgcagttccaccgggtccccggcgacgaagtcgccctggaccgcagcgatcccggcgggcagcagcgagctgccgcgctcggtgaccgcgcggacggcgccgtcgtccaggaccaggtgcccctgcggggtcgacgcgtgctggagccagagcagccggtccgcggagcggcgcccggtggcgtggaacagggtgccggtcccccgcccggcgagggcgtcggcggcctggctggcggaggtcagcaccacggggatgccggcggcggccgcgatccgggccgcctcgaccttggtgaccatgccgccggtgcccacgcccgccttgccggcgctgccgatggagacgtgcgcgatgtccccgggcccgcggacctcttcgatgcgggtggtgccgggctgggacgggtcaccgtcgtagaggccgtccacgtcggagaggaggacgaggaggtccgcgcggacgaggtgggcgacgagcgcggccagccggtcgttgtcgccgaagcggatctcgtcggtggcgacggtgtcgttctcgttgacgacggggagggcgcccatggccagcagctggtcgagggtgcggtaggcgttgcggtagtgggcgcggcggctggtgtcgtcggtggtgaggagcacctggccgacgcggacgccgtaccgcgcgaaggaggcggtgtagcgggcgacgagcagcccctggccgacgctcgcggcggcctgctgccgggccaggtccttggggcggcggcgcaggccgagcggggagagcccggctgcgatggctccgctggagacgaggacgatctccttctcgccgccgctgcgggccttggcgaggacgtcgacgagggcgtccacccgatccgcgtcgagtccgccggccgcggtggtcagggaggaggagccgaccttgaccacgatcctgcgggcgtccacgacaccctgcctagccgctgacacgtctgtccccttgccccttgccgaaatgcctgtctccgagatgcctgccgtctcaatctacggggtgggcgcgcgggactgctcgggggtttcagaccctggacgaggaccccgcctccgcgtgcggggccgtctcggcccgggcggcacccgggacgaggatcttgcgggagagcaggaaggtgaacgggatggccacgatcgccgcgaccagcggggcgatccgggtgtccatcccggcccaggtcaccagcgcgtagaggccggcggactggatgacgtagttggtgacgttcgtcagcgggaagaggaggaacttcttccaggtcggccgggtgcggtaggtgaagtaggtgttcatgaagaacgagccgaccatcgccagcaggaaggcgagggagtaggcggcgaagtagggcatccacgggtgcaggagcaggtagatgccgaagaaggtggcggtgttgaccccgcccacgagggcgaatcggaacacctggccgagctggtccctgcggctcatcgggcgctgcgctccacgatcgtcggctccgtgaccgtcggctccgcgacgcggcccgccgtctgaccgccggtccggggcagcggctgcgccccgtgcgattccttcaccaggaagtgcggccggcgcttggtctcgtagtagatgcggccgatgtactcgccgatcaggcccagcatgatcagctgcacgccgcccaggccggtgatgatcgccacgagggtgacgtacccgggggactcgacgccgtgggtcatcgccctgatcgtgatccagagcgcgtagaggccggtcagggcgaccagcgacacgccgaaccagatcccgatccgcagcggcctgttgttgaaggagatcaggccgtccatgccgtagttcagcagggagccgaacttccacttcgtctcgccggcctcgcgctgcgcgttgcggtagtcgaagtggacggtgtcgaagccgatccaggagaacaggcccttggagaagcggttgtactcgggcagcgccagcagggcgtccacggccgggcgcgagagcatgcggaaatcgccgacgccgtcggtgagctccacgtccacccagcggttgacgccgcggtagtagaggctgctgagggctgagcggagcttcttgtcgccctcgcgcgtgcggcgggcgatgatctggtcgtggccctggtggtagtgctccagcatggtcgcgatgagctcgggcgggtgctggaggtccgcgtccatgatcacgacggcgtcgccggtggcttcgcgcaggccggcgagcatgccggcctccttgccgaagttgcggctgaaggagacgtagcgggtctgctcaccgtgctcggcggcgatcttgcggagcttgtcgagggtgccgtcacggcttccgtcgtcgacgtagcagacctcgtactcgacggggagggcgtccaggacccttcggatttccccatcgaagctgtcgaggacggcttcttcgttgaagcaggggacaactacggacagcttcgtcatgaacacttcctgctggatccgaacgggtgattgtcggcgaccggacccgcctcgcacctcttccttagaagtatgcacggagagggtcggacgggagtcgggctgccggagtcgagggcggcacacggtagcgtggtcgagataagcggaatcagctgaacgtaacgaaacgaagggatcgaggtgcacgtgcccgacgtctccgtggtcgtcatcgtctacaacgacgcagagcgtctgccgacagcagtccggtcggttctggaccagaccctgcacagtgtcgaagtcgtgatcgtcgacgactgcagcaaggaccgctcgtacgcggtcgcccaggaactggaatctgcgcatccagggcgggtgcgcgccttccggctgccggagaacagcggcggctgcggtgcgccgcgcaaccacggcatccagcaggccaccggaacgtacgtgatgttcctcgacagcgacgacgtgctggagcgcaacgcctgccggaacatgctggacgccgccgagcggaccggatccgacctggtctcgggcatgtgcgtacgcgtgcacctcgacaaccggtggggcaagaccaccgagtggtacccctggatctactcgcgcacgcgcaccctggaatcgatcaccgagtaccccgacctgctggtctacgacaccctctccacgaacaagtgctaccggcgcgcgttcctcctggagcagggcctggagttcccggtcggcatccactacgaggacctgctgttctccgcgcaggcgtacgtggccgcccgccgcatcacgctgatcccgaaccacgtctacttctggaacgtggtcgagaaggccgcggccctgtcgatcagcaaccggcgccacgagatcgcgaacttcgtccaccggatggagatccaccgccgcgtcgaccgtctgctggcggacaagggccacacggacatcaagtcggcgaaggacgccaagttcctcaagcacgacctggtgctgcacctgcgcgacctgccgctgctgagcgacgagtaccgccaggagttcgcccgcctcgccaacggctacctcgcggagatcgacccggccgcgtacgagaacgtcacctacctccaggcgatctgcgcctacctgctgggcaaggaggactgggacaacctgctcccggccgccgacgccatgaccaacaagggccggctgacctccccgctcgccgagcgcgacggccgcgtctactggtgcgcgcagcacatcgacggccccgacgccgacgaggcccgccggatactggacgtcaccgagcaggccttccacaccacgcccctcagcggcctcaccgtgggcaaccgcctcacctcctacgaggacgacggccgcggcacggtcaccatgtccggctcgatcgtgaacccgctgggccggatccctgccgacgccgacctgaaggccacgctcgaattccgggcccgccggcagatcggcgtgcgctccttcagcttcccggtggcaacggtgcgccacgcgggggacacgatcgagtggaccgtcaccgccgacgtcgcgagcaccgtccgcccgctcggcatcatcgacgccgtctgggacgtccgcctcaagctgaccgccggcggcgagcggatcaccacccgcgtctcggtcggcggggtcgacctggactcggcggcccggctgcgcgtgcgcccgcgcctgacccggctggtctcggaccgcttcgggcccgaggtcaccaagaagggcaacctcagctacgtgctgagcgccgagggcgccgccgccgtccgcacccagtcgctgatcaacaacgccatacagggcaaggcggccggcgtggtcaagcggggcctgcgcaaggcactgcgggcccgccggaacatgggctccggcgagcagaaggtgaaggtctaccacgaggtcttctcgaagctgccgatcaagaagggcacggtcgtcttcgagagccacatgggcaagcagtacagcgacagccccaaggcgatctacgaagagctggtccgccagggcgcgccgttcgaggcgatctggtcctacgcgggcgccaagcccaccggcttccccaaggaggccaccctggtcaggcgctggagctggccgtacctgcgcgccctggcccaggccgagtactgggtcgacaaccagggcttcccgctggcgctggccaagcgtccggggaccacgtacatccagacctggcacggctcggcgctcaagcggatgggcttccacgagccccggacgaaggcgcagggacgggccgggcaggcccgtttccaggcggccgtcgaccgcttcgaccacttcctgatccgctccgagcacgacacccgcaccctcgccaagggcttccggctgcgggacgaggtgctgctgcgcacgggctacccgcgcaacgacgccctcgtcgaggcgcaccggaccgaggcgaacagcggtgagcgcgtacgcgggcccctcgcggtcgagctcggcatcgacccggacaagaaggtgctgctgtacgcgccgaccttccgggcgggcgcggacggcgcggtggagggcttcaccttccccttcgacgtggaggagttcgcggaccggctcggtgaccgcttcacgctgctggtgcggacccactacctcaacagcgtctcgctgccgccgtccgtcgccggccgggtcgtcgacgtgtcccggcaccacgacatcaccccgctgctggccctcgccgacggtctgatcaccgactactcgtccgtgatgttcgactacgcggtcctggaccggccgatgctgttcttcgcgtacgactacgagaagtacgccacggacatccgcgggacgtacttcgacctgaaggagaaggccccgggcccggtggtgtccacggcggacgaactgctgcaggcgctcgccgccttcgaggaggcggacgtcaagtacgcccaggcacggcagcgtttcctcgccgagttcggcgagtacgaccgcggggacgcggcccgccagatcgtcgagaagttcttcaccaggagcggcaagtgagccagcagaccgccaccccgggcggccgtgacatcttcatcgtctccaacaacgtcgacgagatcggcggtgtgaccacctggtcgcaccagatggcccggcagttcaccgaccgcggccaccgggtgcacatcgtgggcgtcgccccggtcgccgacgacatccggcagaagctgccgcggggcctgccgtacgagatgaccacgctgtacgacacccacccgccgtcggcccgccggctgcgcgggatcaagggccggctgaacgcacccgagcggcgccgtcaggcggcccggcgggcccagatgcgggtcaaggccgagcagctgagcgagctgctgcgggcggcccgtccgggcggtgtcgtcatcgtcacccaggtctgggccatggagtgggtggcgctcgccgacaccaaggggctcaccgtcatcgggatgagccacgagtcgttcgaggccagccagaagtccacgcgcggggagcgggtccgccgcttctacccgcaggtcgaccggctgctggtgctgaccgccgaggacgcggacctgtggatccgggcgggcatggagaacgtgggcagcatgccgaacccgctgcccttcatgcccgactcccccgcgccgcagacggagaaggtcgtggcgtgcgtcgggcgcctcgccttcgagaagggcgtcgacctgctgctcgacacctgggcggacgtcgcgccgcaccaccccgactggaccctgcggatctacggggcgggcgccgaggaggagacgctgagggcgcactgcacctcgctgggcctggacgactccgtggagtggatgggcagcaccgacgacgtgctgggcgcgctgcgcggagcctcggtcttcgcccaggcctcacgggccgagggcttcccgatcacgctgctggaggcgatggcggcgggcgtgccggcggccgccttcgactgcgcgccgggcgtacgggagatcgtcgagcacggcgaggacgggctgctggcccggctgggaaacacgatggaactggccgggcacctgcgcacgctgatcgccgaccgtgagctgcgcgaccggctcggggacaacgccttccactcggtgcggcgttactccagccccgagatcaccgaccggtgggaagagctgttctccttcctggagcgctgaccgcgccttccacggcacacatgaggcagcccgccccggacgcgtccggggcgggctgcctcatgtggtggctgcggtccggccgctcaggccttgtggacgtcccggtgggcgtccttgcgggccaccttgttggcctcccagcccgcccaggcggagacgaccatctcacggacatcgtggcgggccttccagcccagctccccggtgatcttgtcggccgaggccacgaccttcgccgggtcgccggcacgccgcgggctgatcacgggggcgatgtcgtgcccggtgttcttgttcaggagctcgaccatctcggccacggagacgccctcgccgcgcccgatgttgacggtgaggtccttgtagtcgccggccgcggcccactcggcgagcttgcgggcggccgccacgtgggcctccgcgaggtcctcgacgtggatgtagtcgcggatgcaggtgccgtccggggtcgggtagtcgtcaccgaagatcttggcgccctggccggcgtcgtagcgctcgaagaccatcgggaccaggttgaagacgccggtgtcggcgagctcgggggtcgcggcgcccgccacgttgaagtagcgcaggcaggcggtggagatgccgtgcgccctgcccgcggcgcgcaccagccactctccggccagcttggtctcgccgtaggggctcagcggcgcgcacggggtgtcctcggtgaccaggtccacgtcgggcatgccgtagacggaggcggaggaggagaagaggaagttgcggatgcccgcgtcggccacggcctgcagcaggacggcgaggccctgcacgttctcgtggtagtagtacatcggcttctcgacggactcgccgacctgcttcttgcccgcgaggtgcaccacgccggtgatcttgtgcttgcggatgacctcctccagggccagccggtcgaggacggagccgaccaccagcgggacgccctccggtacgcggtcctcgttgcccgtggagaggtcgtcgaagacgacgacctgctcccccgcgagctgcatcgcgcggacgacgtgcgcgccgatgtatccggcgccaccggtgatcagaaacgtcatgtgtatctccttggtcctgtccgacttcgaagtgaagagcacagtggtgtgggccttcctccgggcatgtctccggggcccgtctccgaggcctgtggcctggcctgtggccgggccgtcctggccgtcagcccgccccacggcccgcccgggcccggtggaggcggtttcgtacgaggtagagagcgccctcggcgccgggcgcgaggcgcagcgcgagggcgccggcccccgtccggtagggctgcgccagcagcacaccgtaccggctgctgggcagggcccgacggcgaaggagtcggccccgggggcgcaaggaggtgaacaccgagctcccgtcggcgcagcgcacgcccaccccgacgttccacgcctgcatcctgcgcagcccctggcgacggcccgtgacggccaggtcggcgaggcggaacggcagtacggcgacccagcccccgccggcgtcgggctgcagctcgaccggctgtgcgaggaccgcctcgccgcccgcacggggcatgaagctcagctgggcggtgaccggcccggcctcggcgaggcgcccgtacaggtcgtgcaggcggatccggacggcggcgcggcccgccggttcggcgtcgacggtgacgggcagctcgccgaccggcagcccgggcaggccggccagctcgaccgggagctcctcgctccacacgggagctccggtgggaccggtcgcgtacgggggcagcagccgcggcggttcggcggccagccgggtgagccgctcgacgtcggcgggcggggtcgcggtggcgcgcagcacggaaacgatccagcgggcgtgggccgcggccgactcgatgtccgcctcggggaaggtgtccacgtacgcgcgggtcagggtccaccaggcggcctggtactcggggtcccggccgagctcgcgcaggtacatgcgcaggtcgtactccaggaacttcacccggcaggcgctggccaggagcggggaggcgtccgcgaggatcccggcggccgtgcggtgggcctcgatgcgcgagcgccagttcccgacgtccttgcggtccagggagatcgacacctgggcggcgctgcggcgcacgtgccagacgtagacgaggtcgccggtgacggcgatgcggggggccgcggcgagcacgcgggcggtgaagacgaagtcctcgtagatgaaccggccgtcggggaagcgcaggccgtgctcctggaggaaggcgcgctcgtacagcttgttgacgcagagggtgtcgcggacgaggtcgggccggtccaccggccgctcgatcacctcgcccggtgtgtggagtccgggcatccacgggacgtcgtggtgctggggcagctcgcgccggaccgcggcgccgacggtgaccggggcgcggtgctcctcggcggtgcgcaccagggcgtccgcggcacccggcggcaggatgtcgtcgctgtcgaggaagaggacgtaccggccggaagcagccgcgatcccgtcgttgcggggggtgccgcaccccccgctgttctccgtccggtgcacgaccttgaggcgggggtgcacggctgccagctcgtccagcacctgcgcggtgccgtcggacgaggcgtcgttcaccgcgatgacctcggagaccaccgggccctgggcgagggccgaggaaacggcctcgcccacgagcccggcgtcgttgtacgcgatgaccacgacggaaacggtgggtagcttgctgctgttcacccggaagatcctaggcgaccgacgtaaaggcgccttcaaacctcccgggcacaagtccctcgggaggggctcagaacggcttgaattcgtcgtactcctgctgcgccgcgtccccgcgcttggcgtccttctccttgcggcgcgtggtggccgggcgcggagcgtccaggcggtggtcctcgccgcggcggcccagcatctcggcgccggccatcatggtcggctcccagtcgaagacgacggagttctcgtcggagccgatggccacgccgtcaccggcgcgggcgccggccttcttgagcgcgtcctcgacaccgaggcggttgagccggtccgcgaggtagccgacggcctcgtcgttgttgaagtcggtctggcggacccagcgctcgggcttctcgccgcgcaccaggtagacgtcctcggcctcgtcgtaggtgacggtgaagccggcgtcgtccacggccttcggacggatgacgatacgggtcgcctcctccttcggcttgcgggcgcgggccttggcgatgccctcggcgaggaagtaggagagctccttgagacccgtgcgggcgaccgcggagacctcgaagaccttgtagccgcgggcctccaggtccggacggaccatgtcggcgagcacttggccgtccgggatgtcgaccttgttgaggacgacgaggcgcggacgcttctccaggccgccgccgtagagcttgagctcctcctcgatgaggtcgaggtcggcgatcgggtcgcggtcggactccagcgtggcggtgtccaggacgtgcaccagcaccgagcagcgctcgacgtggcgcaggaactccaggcccaggccacggccctggctggcgccggggatcaggcccgggacgtcggcgatcgtgtagaccgtcgagccggccgtgacgacgcccaggttcgggacgagggtggtgaaggggtagtccgcgatcttcggcttggcggaggagagcaccgagatcagcgaggacttgccggcgctcgggaagccgaccagcgccacgtcggcgacggtcttgagctccaggacgatgtcaccggtcgtgccggggacaccgaggagcgcgaagccgggcgccttgcggcgggcggaggagagcgcggcgttgccgagaccgccgcggccgccctcggcggcgacgtaggtggtgccctggccgacgaggtcggcgaggacgttgccctccttgtcgaggacgacggtgccgtccggcacgggcaggatcaggtcctggccgtccttgccggagcggttgtcgccggcgcccggctggccgttggtggccttgcggtgggggctgtggtggtagtccagcagggtggtgatcgcctgctccaccaccaggatgacgtcgccgccacggccgccgttgccgccgtcgggcccgccgagcggcttgaacttctcccggtgaacggaggcgcagccgtggcccccgttacccgcggcgacgtgcagctcgacgcggtccacgaaggtggtcatgggtgttcctccagatacatacgggaatgtcccgggcaggccgtattactacccctgcccattaaaacgtcgtctgtatgacaacgcgccgagggcggacctctcttcccggcttgcgccgggaagagctgagatccgccctcgggaagttacgaacgctcgatcagccgaagctggatcaggcggccggaacgatgttgacgaccttgcggccacggtgcgtgccgaactggaccgaaccggcctgcagcgcgaacagcgtgtcgtcgccaccacgaccgacacccgagcccgggtggaagtgggtgccgcgctggcggacgaggatctcaccagcggaaacgacctgaccgccgaagcgcttcacgccgagccgctgggcattggagtcgcgcccgttccgggtggacgatgcgcccttcttgtgtgccatgtctcagtccctcttacttcgcagccgcggggataccggtgaccttgatcgccgtgtactgctggcggtgaccctggcgacggcggtagccggtcttgttcttgtagcgcaggatgtcgatcttggcgcccttgtggtggtccacgacctcggccgtgaccttgataccggccaggacccacgggtcgctggtcacggcttcgccgtcgacaacgagcagggtcgagagctcgaccgtgtcgccaaccttggcagtggaaatcttgtcaacctcaacgatgtcgccgacagcaaccttgtgctggcgaccaccgctgcgcacgatggcgtacacgcggatctctctctcactcgggacggatgctcctgaagccagccgctcaggcaagccccgccaagaaggcggaaccgcaccgatccggattggacgagcggcctctctcgaacgacgcttgcgcgtacagaacgtgaggaaggtgctcaggagcgcggcacacaccggacgtcaatcgtccaagcatgccgacggtctaggttacgggcccggttccggagggtcaaaccgggcccctacggccgtgggccccgccgctcggcggggcccacggccgctgtgtcactcagcggtggatcaggcttcggtcggagccgagacggacggaggcgtctgctgctccgccgccgcggtcttcttcgtcgcccgcttcaccgcggtcttcttggtcgtggccgccttcttggccacggtcttcttggcggccgccgccttcttggccggagccttcttcgccgcggtcgccttcttggccggggccttccgggcggccttcttggccggggcggcctcctcggcgaccggtgcggcctcctcggcctcgggggccggggtctcggctgccgggagctcggccgcaggggcctcgacgaccaccacggcggcctcggccgcgcctgccggggaaccggcgggtgcggtggccttgcgggtggcacggcggcgcggacgggccggagcggcctccacgacgggcgcctcctcgacctcggcgacggccacgggctcgggctcggcctcgacgaccggctcgggctccggcacgacgaccggctccggcgccggctccggggccacctcggccgcgggggccggggcgcccgccggggcggtggccttacgggtcgcgcggcgacgggtacggcccttcggcgcggcgtcctcggtcacggcctcggccacgacctccgcgacgacgtccgaggcctccacggcttcggcgacgacctcggcggccggctccaggacggtgtcggccggctcggtcaccggctcggcgacgacctcggccacgggggccggggcctgcgccggagcgaccgcaccgcgcggggcacccgccggagcggtggccttgcgggtggcacggcgccggttgcggcgaccgctgatgcccgcggcggcctcggcctcggccgggctgctgtagagctcctcgtccgcgacgaactccggctcgggcagggcacgcggcgcggcggcctcggcggccacctcggcctcggactcgaagacgccgttgtcgacggactcgaccgtctcgacctcgtgatcgtgctggtcgaactcggcgcggccaccgcggcgcttggagcgcttgccgttgccaccgccgccgatcacggtcggggtctccatgtggacgatgacaccgcgcccgttgcagtggacgcaggtctcggagaaggactccagcagaccctggcccacccgcttgcgggtcatctggaccaggcccagcgaggtgacctcggccacctggtgcttcgtacggtcgcggcccaggcactccagcatgcgccgcaggaccaggtcgcggttggactccaggaccatgtcgatgaagtcgatgacgacgatgccgcccaggtcgcgcagccgcagctggcgcacgatctcctcggccgcctccaggttgttcctggtgacggtctcttcgaggttgccgccctgaccggtgaacttgccggtgttgacgtcgatgacgatcatcgcctcggtcttgtcgatcacaagcgagccgcccgagggcagccacaccttgcggtcgagcgccttggcgagctgctcgtcgatccggtacgtcgcgaagacgtcgacctcggaggtccagcgcgacagccggtcggccaggtccggggccacgtggttcacgtagccgtggatggtctcccaggcgccgtcaccgctgacgatgaccttcgagaagtcctcgttgaagatgtcgcgcacgacgcggacggtcatgtccggctcgccgtacagcaggctcggcgaagaggtcgagatctgcttcgacttcttctggatgtcctcccactgggcctgcagacgctcgacgtcgcggcgcagctcgtcctcgctcgcaccctcggcggcggtgcgcacgatgacgcccgcgtcctcggggacgatcttcttgaggatggtcttcagacgcgcgcgctcggtgtcgggcagcttgcggctgatgccggtcatcgagccctcgggcacgtaaaccaggtagcggccggggagcgagacctggctggtcaggcgggcgcccttgtggccgatcgggtccttggtgacctgcaccaggaccgactggccggacttgagggcggactcgatgcggcgcggcccgttggccatgccgagcgcctcgaagttgacctcaccggcgtacaggacggcgttgcggcccttgccgatgtcgatgaaggcggcctccatcgacggcagcacgttctggaccttgcccaggtagacgttgccgacgtacgaggtggcctcttccttgttgacgtagtgctcgacgagcacgttgtcctcaaggacgccgatctgcgtgcgctcgccggcctggcggacgaccatgacacgctcgacggcctcacggcgggccaggaactcggcctcggtgatgatcggcacgcggcggcggccctgctcgcggccctcgcggcggcgctgcttcttcgcctccaggcgggtcgagcccttgatggactggacctcgtcggaggactcggccttctcacgcgccgggcgcggctcgcggaccttgacgacggtacgcacaccgtcctcgtcacccgcttcggcggcctcggcagagccctcgccgctgcggcgacggcgacggcggcgacggcggctggagctggagccgagggcctcgtcggactcctcgtcctcttcctcctcggcgtcctgctcggcggcgtcctgctcggcggcctcggcctcttcctcggcggactcgtcgaggtcggcggactcaccgcgacggcggcgacggccaccgcgacggcggcggcgcgacgggcgctcgcccgactcgtcgccctcttcgaactcggcggactcctcgtccagctcggcggcctcggcctccggctcctcctccgcgagcacctcgggaagggagaccggcgcggactgcgcgggctcggccaccggagcggactcggcggcgccgcgcccacggcgacggcggcggccggcgggctgcgcgacgggggccgcggtgacctcggcctccagctcggtctcctcctcctcgacctcttcggccggggcggcggcacgagcggccgccgcggccatggccgcggtctcgggggtctggaacatcggctcggcgaagaccggggcctggaagacggccacggcgggacgcgcggcgcggcgggcgcgggccggtgcggcgggctcggcgctctcggcgacgggctgcggggcggcggccggcgcggaggagcgggtggcgcggcggcggccgccgcgcttgggcgagtccacggcgtcggcgacggtcacggcgcgggtggccctgggggcctcctccacgacgggcgcgggctccgcggcgggagcctcggcgacggcctcggcggccggggccgcgacggcacgggtcgcacgacgacgggcacgcggagccggagcggccggagcctcctcctcgaccacgggcgcggcagcctcggcggcggcagcaggagcctcgaccacagcggcggcctcgacggcctctgcggccggagcggccacggcgcgggtcgcacgacgacgggcacgcggagccggagcggccggagcctcctcctcgaccacgggcgcggcaacctcggcggcggcagcaggagcctcgaccacagcggcggcctcgacggcctctgcggccggggccgcgacggcgcgggtcgcacgacgacgggcacgcggagccggagcggccggagcctcctcctcgaccacgggcgcggcagcctcggcggcggcagcggcctcggcggccggggcggtcacggcgcgggtggcacggcgacgggcacgcggagcgggagcggcgggctcctcggcgacggcggcggcaacaggggcggcgaccggctcggcggccggggcgtcgacgacgacggcctccgcggccggagtcgccggggcggccacggcgcgggtcgcgcggcggcggggacgagcgggggcggcggccggagcggcctcttcggcgggggcggccggagcggcctcggtcaccggagccgtctcggcgacggcgccaccgggcgggcccgcgggccgggaagcggcacggcggcgacggcgcggcggcaggttgtcgctggggctgccgctgtcggcgctaccagcaggggtggtgtcgttttcgttgttgagcattgcgggcggttctcccgtcacgctcccgggcgccgcggctgacttccggtccggcgcggctccgcgtagtgagcgcggagccggcctccggggcgcgttcgccacacgggagctgtagtccatggccgccggttccgtacgtgttgtccgtacggcctggcggaagtcttcaggtcagtgcgcggcccgacccaggtggctcccgagtgccagggctgcgcgacgacggcgttccttacgcggcgggaccttccggcgccttcgcgtcggctgctacggcggccgtgggtggagcggccgtgtcagcctcgcggtcgggcgcgagcgggtcggtcaccgtgccggactcctcgtcgaagagcccctgcgccagcctggtcaccgctgaggggaccggcggcgccaggtcggccacagctcggagaccggacaggacgtcgtcgggtcgcacggcaggtgtcagatgccgaacaaccagccgcagtatcgcacaggcattgtccagcggcctatcagccggggcgggaagggcttccagactgacgaccgcgccacgcgtgtcgaaggtccgcattccgttcttggtccggcgctgcacctccacgttctccgcggcgaggaaggccgccacggcacgctcggcctcggcgagctccacgccgtccaggcgcagctcccacacggaggcggtcagccggtcggcgagacccgaggtgcgggcctcgacggcgtcgatgatgtcgagcccggtaggcatcgactcgtcgaggagctcacgcagcttctcggggtcgcggggctcggcgagggcgatctccaggtactcggcctcgctgccggtcccggtcggggcggcgttcgcgtacgagacgcgcgggtgcggggtgaagccggcggagtacgccatcggcacctcggcgcggcgcagggcccgctcgaaggcgcgctggaagtcacggtggctggtgaaccggaggcggccgcgcttggtgtagcgcagtcggatgcgctgcaccaccggtgcgggaggcgggccttcgggctgtcgcttgcccagtggttcttctccttgtgcggggctccgcggctcgcgcgtcgccctgaggtctgtcgacccgctccggctcacccctgccgtcggggcaaggagatctcgtcagcgggtgccgcgtcggcggctgtcgtactacccagagtacgcgcccgtgacctcgccggttccacgtgaggagtaccgaacagtgcctgtcgcacagcggcccgtgcctcccggaccgcggcgcggcccgtgcgccagacctcgcggacggcgtggccgacgggcgtcagcacgtaccggtacacccgggaggcgggccagccgacgagtacccagccgacccacttgacgccgcgccacagggcgccgacgatccgcccggccacccgccaggcccagaggaggacccgcccggcgggcgcgagcacgtaccggtacaggccgacggccagccacgccaggcccagcccgacgggccgcagcaggtaccggaacgcggcggccgtcagccgtacgaggccgtgcccgaccggagtgagcacgtaccggtacaccgccacggccagccatgcgatcccgcggccgacgggcgcgagcacccagcgccacagcgcggcccacggccagacgaacagcgtcatgccgagggcccacacgatccacgtgacgcccttggcgaggggcgcgagcaggtagcgcatgccaccccggccgagccaggcgagcgccgcccagagcggccgcagcacgtacgtgaccaggatccgcccggccggcgcgagcaggtggtcgtacacgccgcggcacagccacgccagcccctggccgaccggggcgagcacgtaccgccacagcccgacccacggccagacgaagaccagcttgagcagggtggcgagcagccatcccagcgcacgcaacagcggcgccaggacatggacgtacagcggcccgagcacgtgccggtgcgcggcgcggccgaaggcggccagcagttcccagaccactcgtacgggcagtacgacgagtacggcgacgatcttcacggggatcctgatgacgcccaccaggcacccgtcgccaccgtcggcggaaggccgtttgtccatgtccatgcagtgaaggacacggcgaaggcccccacccgttgcgggcgggggcctctcgtgacccaagggttacttcacgacggtcagcggaagcagcttcttgccggtcgggccgatctggatctccgtctgcatctgaggacagaagcccacacgcccacatccagcgccaccaacgtgtcgttgggcagcccatgaagaaagctgcagaaatccggcccagaccccacacgacgaacgctcactggcgcgagcccgatctggccctgctgaaggagctcatagcggcggaggcgtttctgcctccggacgcgccacgggcgcttctgtcagtgaggctctcgacgctcaccaccgagaccacgtcgcccgtcaggcaagaactcgacctgcgccgccttgcccgggagcggggttaccgggtcgtcggtgtcgccagcgatctgaacgtctccgccgtccgggtcccgccgtggcgccgcaaagagctcggccactggctgaacgaccgggtacccgaattcgacgtactgctcttctggaagctggaccgcctcgtccgcaggctcacagatctcagcaccatgatcgagtggtgcctccggcaccggaagaaccttgtctccaaacatgatgcgatcgacctgtccagccctgcaggacaggtgatggcagagctcatcggtggtatcgccgaaatcgaggcagcggccatcagcacccgtgtgacgagcctctgggactacgcgaggtcgcagtccgactggctcgtcggcaagcctccgtacggctacgccatcgacgatcggggcaggctggtcatcgacccgcagaagcagcgcgtgctgcgctggtgtctgggcgcagccttgcgcggggtctcggctcggcggatgaccaccgtcctcatccgcgcccaggtcccgaccggcggaggcgggcagtggagcgccggcactctgctgcgaagactgcgaaatccggcactcatgggtttccgggtcagcgagagcaagaacggtggtacgaggcgctcggagaccgtcctgggcgcggacggcaacccgatccgggtggccgatcccatcgtcacggaagcggagtggctttccctccaagcggcgttgggtgaacgggcgaagtcgcagccggcccgacgcaagggcggcgcgaccgcgtttctgggagtgctggtgtgcgcggattgcggcacgcacatgacggcgcacaggagcagggggaaggttcgcacgtacgagtacctgcggtgccggaggtgtcccagcggtggtctgggtgctccggatccggaatccgtctacggccgactgaccgatgaggtcatgagcgcgttgggcgcggagccggtccgggtcagggagtacgcaccgggcacggacggccgcgatcggcaaaagggtgtcgaggacgccatcgcccactacatgaccggtctggagcccggcgggcgatacacccgggcctccttcacccgtcagcacgcggaacagaccctggagaagctgatcacggagctggaggagctggattcacggactgcacgggaccgctggctgcagacgtccagcggcggcaccttccgcgagcgctgggatcaggaagacagggaaaccatggccgacgacttacgccgagcgggaatcacctgctcggtcggcagacgcaaggttctcggtgtccgcgcaccggaggtgggcctgaagctgatcattccctcggatgcgcgggaacgcctggtcatcaagagggacgccttcaccgtcgaatcctcatgagacgccgtcggccctgtcaaggacagggccgacggcagcgcttctacttgttgacgaccgacagcggaagcagcttcttgccggtcgggccgatctggatgtgcgtgtcgagctgaggacacacgccgcagtcgaagcacggggtccagcggcagtcgtcgacctcggtctcgtcgagggcgtcctgccagtcctcccagagccagtccttgtcgagaccggagtccaggtggtcccagggcaggacctcctcgtaggtgcgctcgcgggtcgtgtaccaggccacgtccacgccgtaggcgggcagcgtcttctccgccgcctccatccagcggtcgtagctgaagtgctcgcgccagccgtcgaagcggccgcccgactcgtacacggcgcggatgacgtcgccgatgcggcggtcgccgcgggagaggaggccctcgacgatgcccggcttgccgtcgtggtagcggaagccgatggagcggccgtacttcttgtcgccgcggatcttgtcgcggagcttgcccaggcgggcgtccgtctcctcggccgacagctgcggcgcccactggaacggggtgtgcggcttgggcacgaatccgccgatggacaccgtgcagcggatgtcgttctggccggagacctcgcgtcccttggcgatgacgttgaccgccatgtcgccgatctggagcacgtcctcgtcggtctcggtgggcaggccgcacatgaagtacagcttgacctggcgccagccgttgccgtaggccgtggagacggtccggatcaggtcctcttcggagaccatcttgttgatgaccttgcgcatgcgctcggagccgccctcgggggcgaaggtcaggccggagcggcgaccgttgcgggtcagctcgttggcgaggtcgacgttgaacgcgtccacgcgggtcgacggcagggacaggcccaccttgtcgtccgtgtagcggtccgcgaggcccttggcgatgtcggcgatctccgtgtggtccgccgaggacagggagaggaggccgacctcctcgaagcccgtcgccttgaggcccttctccaccatctcgccgatgccggtgatgcttcgctcccgcacggggcgcgtgatcatgccggcctggcagaaacggcagccgcgggtgcagccgcggaagatctccacggacatgcgctcgtggacggtctcggcgagcgggaccaggggctgcttggggtagggccactcgtcgaggtccatgacggtgtgcttggacacgcgccacggcacgccggagcggttggggacgacgcggccgatgcggccgtccggcaggtactcgacgtcgtagaagcccggcacgtagacgttgccggtcttggcgagacggaggaggacctcttcgcgtccgcccggccggccctcggccttccaggtgcggatgatctcggtcatgtcgaggacggcctgctcgccgtcgccgatgaccgcgcagtcgatgaactccgcgatcggctcggggttgaaggccgcgtggccgcccgcgaggacgatcgggtggtcgacggtgcggttgcgggcctccagcgggatgcccgcgaggtccagcgccgtgagcatgttggtgtagcccagctccgtggagaaggacaggccgaacacgtcgaaggcggagaccgggcggtggctgtccacggtgaactgcggcacgttgtgctcgcgcatcagttcttcgaggtcgggccacacgctgtaggtgcgctcggcgaggacgccctcgcgctcgttgagcacctcgtacaggatcatgacgccctggttgggcagcccgacttcgtatgcgtccgggtacatgagggcccagcggacgtcgcagctctcccacggcttgaccgtggagttgagttcaccgccgacgtactggatgggcttctgcacgtgcggaagcagggcctcaagctgagggaagaccgactcggtcatcacgcgactttcgtgaagcgggcagggggcagctatctagcgtaccccgatggctcagccgcccccacccgcatgatcacttcagggccgtccgcagggcgggggccgagaccttcgcccagatgtcggggagctcccgctcgcgccgctcggccagggcctcttcgcgtccgtagagcaggccccaggtgaaggcgggctctcccgcggccgtcgcctgggcggcgaggccgcgcagggcgtcgcgggcgaccacgctgtcctggtggtcgccgagcagggtctggaccttcttcacggccttggccaggtgtttcgccggtttgccgagctcgggcacggccgactccgccgcgtaccggacgcgcttggccgccttgcgggcctcgtggagggccaggtcgcgttcccggccctcgtcgagggcgagcgcgccgtcgatgcgggtggcgaggcgtgcgtagtcgcggagcaccgccttggggaggaccttctccggggacctggcggcgccgtcgagcagcgggggtgcgtcgagcagtgcgtcgagggtgttgaggagggtgacgtagcggtcgctgtcgagcgcggccagggccttgcgccgcgatccggagcgccggctggtgttccaggtccgcagccggctgcggaccgggccggtgaggagggtgcggggcagttcggcgaggtgggcctggagccgctccatcaggacctcctggtctcggtcgacgccgagttcggcggccagccagcgcagttcctcgccgatggggtcggtgacctcgcggtccaggaccttgcggtaggtcttgaaggcgctgcgcagccggcgggtggcgacccgcatctggtggacggagtcgggcaggttccgtcgtacggccgggtcctgggcgacgagcgcgtcgcgctgttcggtcaggtacgcgagcacgtgtgcgcccgcggtgcccccgggtccgccggctccgggccgggccgggggttcggcgtcggtctcggcgagggcccgggcgagtttggagggggcgtcggagacccggagcccggctttgcggaaggtctcctgcacggcgtcgaggagttcggggtcgacgccgtcggcgagttccacctcgacctcggtccaggcggcggtggtgtcaccgcgttcggcgacgacggcgtcggtgctcagttccgcgagcagggcgccggaggcgtcgaggaggtggctgaccttgcgtgaggagaggagcctgacctgcggccggagtccggcgtcgcggacgcgggagcggacgagggcggcgagggagggcgggaccgtgtcgctgagtgcggcgccgatctcgtcgcgcacgcccggggagacgggcagtttgaggtgccagccctcgtccgcgccgcccgttctgcgcctgagggtgaggccgtcggcggcgagcctctggtcgggggtgtcgtagtagacggcgtcgaggtcgacggtgccctggtcggagacggccgcgatcgcggccgtgcccgtcaggtccgggactccgcgccgggcagatttggccttggagaactcgaattttcgctcgatttcgcgcttggtgtccgccatagaccgaacttagtcctgaacggatcacgtcggcagggtgaacagcacatcaggctgacaatggccgctgcaccttgatcgactgcagtagtccgatcgccacccacaccgcgaacatcgacgagcctccgtacgagacgaacggcagcgggagcccggccaccggcatgatcccgagggtcatgccgatgttctcgaaggactggaacgcgaaccaggcgatgatcccggcgcagacgatcgtcccgtacagctcggtggtctcccgggcgatcatgcaggcccgccacaggatgacgccgagcagcagcaggatcagcccggccccgacgaagcccagctcctcccccgccaccgtgaagacgaagtcggtctgctgctcgggcacgaactggccggtggtctgcgagccgtggaagagcccggagccggtcagtccgccggagccgatggcgatgcgcgcctggttggtgttgtagccgacgccggccgggtcgagctcggggttggcgaaggccgcgaagcggttgatctggtactcgtcgaggacgccgagctgccatatcaggatggcgccgctcgcgccggcgccgagcaggcccaccacccagcggttggaggcgccggaggccagcagcacgccgagcacgatgacgatcatgaccatcacggagccgaggtcgggcatcagcatgacgatgcccatcggcgcggccgccaggcagagcgccttgacgaccgtgcggtggtccggatgggcgaggtcgcccgcgtccacccgggtggccagcagcatcgccatcaccaggatgatcgtgatcttcacgaactcggacggctggagggagaagccgccgccgatgacgatccacgcgtgggcgccgttgatggtggcgccgagcggggtgagcacggcgaggatcagcacgagggagagcccgtagaggatcggcacggcgccgcgcagggtgcggtggccgagccagatcgtgccgatcatcagcacgaggccgatgccggtgttcagggcgtgccgggccaggaagtagtacgggtccccctggttcagcgaggtcctgttgcgggtcgccgaccacaccagcatggcgccgaggaaggagagggcgagcgcggagaggagtatcggccagtcgagccggcgcaccaccgagtcgcgggcggtgagcttggccatcgccccgcgctcgggcgcgtaccgggagacggagaacttgttggcggtctgcatgtctttcctcagtcctggcgtgccgcgggcggtgcgggcgggccggcgagcgccggcggctccagctcctccggggacggcggcacgtacggccggatgtccggggcgatgatggtgccgtccggggcgatccggggcagcttcgcctcgggcttgatcagcagggccttcttcgggtcctgtttgccggacatggtgaggccgtagatggcgttgtagacgttgcgcacggcggggccggaggcgccggagccggtgccgccctgggagatcgtcatcacgatcgtgtagtcctcggtgtacgtggcgaaccacgaggtggtctgcttgccgtagacctcggcggtgccggtcttggcgtgcatggggatctgcttctggggccagccgccgaagcgccaggcggcggtgccgcgggtggcgacaccctccagcgcgccctccatcttgtgcctggtctcctcggtcatcggcagccggccgtgggcctgcggcttgatctcttcgatcttcttgccgtcggcactgatgatggccttgccgatggtcgggttccacagggtgccgccgttggagatggccgcgtagatggtggccatctggatcggggtcacgagggtgtcgccctggccgatggagtagttgacggcgtcaccggcgcgcatgaggttgccttcgaggcagttctcgtaggacagcagctcgacgtaggtgccgcccttcttgccggtcttgcaccacatgtccttgttggcttcccagaacgcctgcttccagcggcggtcggggacgcggcccttctcctcgccgggcaggtccacgtgggtctcggcgccgaggccgaattggtgggcggtcttgtagaagatctcggccgggtgcttcttcggcttgagcccgccgtccttgatccactgctggtggcccagggcgtagaacacggtgtcgcaggagacttccagggcgcggccgagggtgatcgagccgtggccctgggactcgaagttcttgaagacctggccgccgatggcgtacgagctcgggcaggggtactcgccgtcgaacttgtagcccgcgttgaccgcggccgcggtcgggatgaccttgaagatggagccgggggcggcctggccctggatcgcccggttcatcagcgggacgttggactccttggcggtgagcttggcgtagtccttggcggagatcccgccgacccagacgttcgggtcgaaggtcggggcggaggccatggccaccacgcggccggtcttggactccaggaccacgatggcgcccgcgtcggccttgtaggggacgccggtgttgcggtcgatctgcttgcgcgcctcgaccatggccgcgttcagctcgtactcggcgactccctggacgcgcgcgtcgaggctggtcacgaggtgggcgccggggaccgtcgggtcgttcctggcctcgcccatcacgcggccgaggttgtcgacctcgtagcgggtcacgcccgatttgccccgcagttccttgtcgtaggtgcgctccaggccgaagcggccgacctggtccgagcgcaggaagggcgagttggtgtccttcgccttgatgatctcctcgtcggtgaccggggagaggtagccgagcacctggcccgtgttggcgccgccgggcgccgggtagcggcgtacggcggcgggctccgcggtgatgcccgggaagtcctcggggcgttcgcggatctgcagggcctgctgggtggtggcctccagcgtgaccgggatcggctggtagggggagccgttccagcagggctgcggggtctgggagtcgcagaggcggaccttgtccacggcgtcctgcggcttcatgtccaggacggcggcgaggcgggtcaggacgcccttgcccctgtccttcatcttcatcagctcggtgcggctggccgagacgacgagacgggtctcgttgtcggccagggggacgccgcgggcgtcgaggatggagccgcgcacggcgggctggacgacctgctggacgtggttgctcttcgcctcgtggtagtactcgtcgccgttgcggatctggaggtaccagagccgcccgccgagggtgagcagcatggagaagacgagcacctggatcatgacgagcctgatctgcacccgggaggtgcggccggtctccggaacgttggtcacgactgctcctccctcacagctttttgacgctcttcacacccttgaccggcttgaccccctttatgcggacggctttgttggcccgcgagcgcgcggtcttcaggcgcagtccgccgcgctggctgccgatgcgcaggcccgtaccgccggccagccagccggcggagacgtcggcggccttgttggcggggccgccgccggcctcgacggccatcgggtcgttctcggcgcgccgggccagggccatgatgaacggcacggtgaacggtgcgagcagcaggtcgtagagggtcgcggtgaacagcagcccggtcaggcccacgtggcgggcggcggtgtcgccgacgagggcgcccacaccggcgtagagcagggtggagccgatcgcggcggcgacgacggtgagcatcgggccccaggcggaacggaaccggccgccgtcggggcgggtcagaccggcgacgtagccgatgacgcacaggacgagtgcgtaccgcccggcggcgtggtcggcgggcggggccaggtcggcgaggagaccggcggcgaagccgatgagcgcgccgctgacgtgcccgtacacgagtgcgagcgagacgacggtgaggagcagcaggtcgggcacggcgccgggcagttggagccggcccaggacggtgacctggatgacgagggcgaccacgacgagggtggccgagagcaggatcctgttgaagcgcatgacggtctgtcccctactcgtcggccggcttggcgggcactccggccgtccccgacggggtcacggtgacggtgaccgtcggggtgggcttgggagcctcgggcttgggcggcaggaccgcgtcgcgggggtcctcgcgtggcggcatcacgacgacgccgacgatgtccaggcgcgagaagccgacgaacggacgcacccagacggtgcgggtcaggtcgccgcgcgaggggtcgaccttgaccacctcgccgatcggcacaccgggcacgaagggcttgttgccgcgcgagccgaaggtgacgagccggtcgccggggctgaccttggccttgccgttgagcatctggacggacagggcgcggtcgccctggccggtggcgaagcccagttcgccggtcttctccagccgggtgccgacggtgaagtcggggtcgttggcgaggacgacggtggccgtgtcggggccgacggtgctgacccggccgacgagcccgtccccgttgaggacggtcatgtcgcgttcgatgccgtccttgctgccggcgtcgatggtgacggtccaggagaagccctgggccgctcctatggcgatgacctcggcgcccttgatgccgtactgtccggcgccggcccgcttgagcatctcgtcgagctcgtggatgcggctgcgggtctggtcctcgctgcccagcttggccttcagtgccgcgttctcgcgctccagcgtggcgatgcggttgtgtcgctcgccggagtcccgtaccgcccctatggcgttggcgaccggatcgaccgcggtcgccacaccttcctcgaccgggccgaagaccgccgcggcggcctgccgggcaccgtcgaccggcgactcctcgcctgccctgatgtccaccgtgatcaacgcgaacgcgatggcgatcagaagcaccaggagcagccggctttctcgtgtgtccctcacgtgcggcggccgtgccttcctcgtcggatttctcttttgcctgtatatcaacgatccgccgcacgggcccggtagcacccgtacggcggatccttgtgttccgcatggcccctccccggcggggaggggcatctgtcagcgacggggctgggcgtccaggacctgctggagggcctcgaactcctcgacgcacttgccggagccgagcgcgacggagtcgagcgggtcctcggcgatgtggatcggcatgccggtctcccggcgcagccgctcgtcgagtccgcgcaggagcgcgccgccgccggtgaggacgatgccgcggtccatgatgtcgccggagagttccggcgggcacttgtcgagcgtggtcttgaccgcgtcgacgatggagttgaccggctcctcgatggccttgcgcacctcggcggccgagatgacgaccgtcttgggcaggccggagaccaggtcgcgaccgcggatctcggtgtgctcgtccttgtcgaggtcgtaggccgacccgatggtgatcttgatctgctcggcggtgcgctcaccgaggaggagcgagtactccttcttgatgtgctggatgatcgcgttgtcgagctcgtcgccggccacccggatggactgtgccgtgacgattccgccgagggagatgacggcgacctcggtggtgccgccgccgatgtccacgaccatgttgccggtggcctcgtggacgggcaggcccgagccgatggcggcggccatgggctcttcgatgatgtgcacctggcgggcgccggcctgcgtggacgcctcgatgacggcgcgtcgctccactccggtgatgccggagggaacgcagaccaccacgcgcgggcgggccaggtagcggcgcttgtgaatcttgaggatgaagtaccggagcatgcgctcggtgatctcgaagtcggcgatcacgccgtccttgaggggccgtacggcgacgatgttcccgggcgtgcgcccgatcatcttcttcgcctccgagccgaccgccaggatgccgccggtgttcgtgttgatggcgaccacggacggctcgttcaggacgatcccccggcccctcacgtacaccagcgtgttggcggtcccgaggtcgatcgccatgtcacggccgatgaacgacattttgttccccttgttccccatgaggagcgtctggccttccagttgatagcggctgctgtcaggtcggcgaggtgggtgtgtgggtggaggccccatcgtagtgccgcaagtacgaagaccgcgcgacgggactccggcaatcccgccggaatggatacccgccccctcagtggtgacgacgtgtcctgcccaggcgttcccgcttctgcccggaaataccggagggcgaccgaaattacttcggtcgccccaggtcatgagcgctattcggctgatgttccgtcaggaaagagtgctcagagcgccgggaagaacagcttcagctcacgttcggcggactcctccgagtccgaggcgtggatcaggttctcacgcgtgatcgtgccgaaatcaccccggatggagcccggcgccgcggcgatcgggtcagtgggtccggccagctggcggacaccctcgatcacgcgctcgccctcgaccaccagggcgacgatcgggccgctcgccatgaagcccatgaggggctcgtagaacggcttgcccttgtgctcgccgtagtgcgcctccagggtctcctggtccagcgtacgcagctccagcgcggggatggtccagccggccttccgctcgatgcggccgatgatctcgccgaccagaccgcgacggacggcgtcgggcttgagcaggacgagggtgcgctgggtcatgttgcggctccttgcggcaaacgggtgcggtagggcgaatctacagggccggtccggggacccgtcacgcagcgtcaggcgccgcgggtgcccccggcgcctcctgagcggccgcccagcgcgccttgatcgtgtcgatcttgcggccgtagtgcacggagcaccaccacagcccggcgaacaccgcgccgaggaagaacatcgtcggcacgacgaacccgctcacgatcaggccgatctgcagggcccagcccagcgggaccgccccgggacgcgacagcatcccgcacagcagcaccgacagcagcatggtgaccccgcacaccgtccagaccgtggcctgggtcagatcggggtccttcatcgccaccagccccgcgaagccgatcacgaagaactcgccgatcagcgtgctcgcacacagcgtgcgcatccctcagcccctcttcagcagcaggcgggcctcgcccaccgtgatcacggaaccggtcaccaggactccggcccctccgtactcggcctcttcctccgccagggtgatcgccgcctccagggcgtcgtccagccgcggctccacctgcacccgctccgcgccgaagacctcgaccgcgacggccgccagctcgtccgcgcccatcgagcggtggctggagttctccgtgaccaccacctccgcgaagatcggctcgaaggcctccagcagcccgcggacgtccttgtcctcgctcgcggccaccaccccgaccagccggctgaagccgaacgactcggtgaccgcctccgcggtggccgccgcgcccgccgggttgtgcgccgcgtccaggaccaccgtcgggctgcgccgcacgacctccatacggcccggcgaggacaccgaggcgaaggccttccgtacggtgtccacgtccaggacccgggcgtgctcctggccgatcccgaagaaggcctcgacggcggccagggccaccgccgcgttgtgcgccatgtgcgcgccgtacagcggcaggaagatgccgtcgtactcgccgcccacaccgcgcagcgtcagctgctggccgccgaccgcgacctcgcgcgagacgacgccgaactccatgccctcgcgggccaccgtggcgtccacctcgacggccttcttcagcagcacctgcgccgcgtccaccggctgctgggccaggatcacggtcgcgtcctgcttgacgatgccgcccttctccacggcgatctcgccgggcgtggagccgagccggtcggtgtggtccaggctgatcggggtgaccaccgcgacggacgcgtcgatgacgttggtcgcgtcccagctgccgcccatgccgacctcgaccacggccacgtccaccggggcgtccgcgaaggccgcgtaggccatcccggtgagcacctcgaagaaggacagccggaactcctcggcggcgtcgaccatctccacgtacggcttgatgtcgtggtacgtctcgacgaaccgctcggcctcgatcggcgccccatccaggctgatccgctcggtgatcgactgcacgtgcgggctggtgtagcggccggtgcgcagctcgaaggcgttcagcagggcctcgatcatgcgggccgtgctcgtcttgccgttggtgccggtgacgtggatggacgggtacgcgcgctgcggctcgcccagcacgtccatcagcgccgcgatccgcgacaccgagggctccagcttggtctcgccccagcgggtggcgagctcctgctccacctccagcagcgccttggcgacctccgggtcgaggggcagggcgggtaccgggtctccctggggcgggcctgcctgggcgcgcagggtgcggctgccggcctcgatcaccgccaggtcggggtcgcggtcggactcttccgccacgatctggtcgaactcgtcgaaggtggcggcgaggtcgtcgttgtcgtcgcggtcgtggctctcgggctgctggtcactcacagggccagtctacggatggggacccggaggactttcggcccggccgtttcgggacctccggcgcccggcgcgacgtgatcgtcgtgcaagccttgcggcagcagataggggaacaaatgccgcaggccagcagcgacaagacagcgtccagccgcgacatagggatggacctgggtaccgcgaacaccctcgtctacgcccgggggcacgggatcgtcctcgatgagccgtccgtggtcgccgtgaaggcgggcaccaccacggccctggccgtcggtacggaggccaaggagaccatcggccgcactcccggctccatcaccgcgatccgccctctgcggggcggtgtgatctgcgactacgaggccgcggaggagatgatccggcacttcgtccgcaaggccgtcccgggccggcggccccggacccggatggtgatctgcgtgccctcgggtgtcaccccggtcgagcggcgggccatcgtccaggcctccacacgggccggggcccgggtcgtccacctcgtcgaggagccgatggccgcggcgatcggcgccggactgccggtgggcgaagcccgcggctccatggtcgtggacattggcgggggcacctccgaggtcgccgtcatctcgctcggcggcatcgtcacgtcccagtcgctgcgtgtcggcggggaccggctcgacgcggccgtcatggagtacgtacgcaaggagcacgggctgctgatcggcgagcgcaccgccgaggacgtcaaggtgggcatcggctcggcctggccggtcccggaccggccggaactggagacgcgcaccttcaccgtgcgcggccgcgagagggtcggcggcatgccgaagacgctcgtgctgggcgccggggacgtacgggccgcactcgacgagccggtggaggcgatcatcggggcggtccgcggcacgctggaggagtgcccgccggagctgtccggtgacgtgatggagcacggcatcgtgctgaccggcgggggcgcgctgctgcccggcctggacctgcggatggcctcggcgacgggcatcccggtcttcgtcgcggacaacccgctggagtgcgtggcgctgggctccggccggtgcgtggaggacctggacgccctcggcggcctcctggccccggcgaaagcctgaggccgccgcggctcagccgcgcgggagggtggcgacgacctcgtaggaggtccgcgtgcgcgtggccgtcagggtgccccccaggctgcgtacgcgctcggacatgctcgccgtgcccgagcccgccgagacgggggcgcggcccggggtccgggccggcagtgcgttgctgaccgctatccgcagccgcgggccgtccgtcgtgatcgccacgtcgatggtctccccgtgcgcgtgcttggcggcattggtcaggcactcctgcaccacccggtagaccgccgcctgccgcagcggggagagcccgtgcgcgtcctggtccatggtgagccggacgggtgatccggcccgcccgctctcctcggcgagcgccgccagcccctccacgcccggggtcgaggcccgttccccgcgctgcacgatgatctcgttgagcaccaggtgggcccgccgtgcggtgtcggccagctcctcgaagtccggcccgtacgacgtctcgcgcgcccgcatcgacagcacctcggagcggacggtgagcagggtcagctcgcgcccgacgaagtcgtggacgtcgcgggccacggaggtgcgctcctgctggacggcgtggagcacggcggactcggcccgccgggcggtcagctccgccaccaggtcgtgccggtaggcggcgatgcccaccgccgatgccagcaccccgatgggcacgaccacgctgaggaagccgctgagggtctccccccggggcgcgggccagtccggcatgcagaacatcaccagcgcgaagccgaggtacccgagggtggcgaggattccggcccggcgcccccggtagcggccgaccgagtagagggcgaactggatcagggtgaactcgtgcagccacccgatgaagagcagcgcggccaggtacgagatccagggctgccggcggcgcaccagcagggtggcgcagcccagggtgaggacgacggcggcggtgggcccggtcagcgagttgtcggcggcggcgagacccggaaggtcgagggccatcagaccgaggcagccgagcgcggtgaggacgtccacggcccgcggcgacccggcccagctctcggtgagccggcggccggaagtcaccagccggtcgaaggccgggacggcgggcttgacgcgcatgccctccatcatccgtggtcagcgcttcggttcggatcgcccggaaccgaaaaacgagtgatttagggcacttcggacagtcgtccggtgtgacagggacgcccccaggggaagggatacggcgaaggcccccgcatcgaccgacggtgcgggggccttcacctgtgcgtacgtaccggggtactaggcggccggcaggccgtccagctgcgcctggagccgggcgatgtccgcctcggccttggcgagccggcccttgatcttgtccacgacgttgtccggggccttggcgatgaacgcctcgttccccagcttcgcctcggcctgctgcttctccttctccgcggcgcccaggtccttcgtcaggcgcttgcgctcggccgccacgtcgatggtgcccgacaggtcgagcgcgacggtgccgccggcgaccgggagggtcgcggtggcgctgaaggagtcgccctccggctggaggcgcagcagctggcggatggccgcctcgtgggcgcccagcccggtggcgcccagctccagacgcgccggaaccttctggccgtcctgcagaccctgctccttgcggaagcggcggacctcggtgatcaccgactggacggaggcgatctccgcctcggcggcctcgtcgcggaagccgctgtccgtcggccagtcggcgatgacgagggactcgccgccggtcagcgtggtccacagcgtctcggtgacgaaggggacgaccgggtgcagcagccgcagcatgacgtcgacgacctcgccgaggacccggccggagaccttggcctgctcgccgcccgcgaagaaggtcgtcttcgacagctcgacgtaccagtcgaagacctcgtcccacgcgaagtggtagagcgcctcgctgagcttcgagaactggtagtcctcgtagtacgcgtcgacctgcgcgaccgtctcgttcagccgggacaggatccagcggtcggtggccgacagccgctcgacgggcggcagctccccctcgatcgtggcgccgttcatcatcgcgaaacgcgtggcgttccagatcttgttggcgaacttgctggacgcctggacccagtcctcgccgatcgggacgtcgatacccgggttggcgccgcgggccagggtgaagcggaccgcgtcggacccgtacttgtccatccagtccagcgggttgaccacgttgccgaaggacttcgacatcttcttgccgcgctcgtcgcggaccatgccgtgcagggcgatggtgtggaacggcggggtgccgtccatcgcgtacaggccgaacatcatcatccgggcgacccagaagaagaggatgtcgtagccggtgaccaggacggcgttcgggtagaacttcgccaggctgtcggtctgctgcggccagccgagcgtggagaacggccacaggcccgaggagaaccaggtgtccaggacgtcggtgtcctgggtccagccctcgccggcgggcggctgctcgtccggtccgacgcagacgacctcaccgttcgggccgtaccagaccgggatgcggtgcccccaccacagctggcgcgagatgcaccagtcgtggaggttgtcgacccagtcgaagtaccgcttctccatctcctgcgggtggatcttgacctcgccgttgcggaccgcgtcaccggcggccttggcgagcgggccgaccttgacccaccactgcatcgacagacgcggctcgatggtggtcttgcagcgcgagcagtggccgacggagtgcgtgtacgggcgcttctcggcgacgatccggccctcggcgcgcagcgcgccgacgatggcggagcgggcctccagccggtccaggccctggaaggggccgtgggcggtgatgatcgcgtgctcgtccatgacggcgaggttcggcaggttgtggcgctggccgatctcgaagtcgttcgggtcgtgcgccggggtcaccttgacggcgccggtgccgaactccgggtcgacgtgctcgtccgcgacgaccgggatgcggcggccggtgagcggcagctcgatctcggtgccgacgaggtgcttgtagcgctcgtcctcggggtggacggcgacggccgtgtcacccagcatcgtctcggcgcgggtggtcgcgacgacgatggacgcgtcgccctcgccgtagcggatcgagacgagctcgccctcgtcgtcctggtactcgacctcgatgtcggagatcgcggtcaggcagcgggggcaccagttgatgatgcgctcggcgcggtagatcagctcgtcgtcgtagagcttcttgaagatggtctgaacggcctcggagaggccctcgtccatggtgaaacgctcacgggaccagtcgacgccgtcgccgaggcggcgcatctggccggagatctgaccgccggactcgcccttccactgccagacgcgctcgacgaaggcctcccggccgaggtcgtggcgggacttgccctccttggcgagctcgcgctcgacgacgttctgggtggcgatgccggcgtggtccatgccgggctgccacagcgtctcgtagccctgcatgcgcttgcggcgggtgagggcgtcgatcagcgtgtgctcgaaggcgtggcccaggtgcaggctgccggtgacgttgggcggcggaatgacgatcgcgtacggaggcttctcgctcttggcgtccgcctcgaagtaaccgcgctctacccagcgctcgtagagcttcccttctacctcggccggcgcgtacgtggtcggcagttcggagtcggggctgctgggtgtctgcgtgttctcggtcacggggcacagtttagagcggtaacagtccagtcatgaaaccggtattccaggggcccggcgccctgcccgcgccgggcttccgtcaggatgtgtgaaacggataagcaacctcattgggggacgcgggatgagctacaaccagccagggccctacggccagcagcctcagcagccgggaccgtacgggcagcagccggccccgcagcccggcccgtacgggcagcccgcggccccgcagccgggctacggctacccgcagcagccgggagtccccccgcagggctacccccagcagccgccgaccccggcctacggctacccgcagcagcaggccccgtacggcgggcagcccccgaagaagtccaaggccggtgtgatcatcggcgcggtcgtcgcggtcgcggtgatcgcgggcggcggctggtacctcctcggcggcggcagtgacatctccgccgacaccaagggctacaagctggtcgcgccggagtcggtggacgacttcaagaaggacccgaagtacaaggagaaggccttcaccgacgaggacaagaaggaagccgaggccgcgggcgtcaagaacccgacccaggtgggcatggactacctggccggcgaccccaagaacccgctgacggccaagggcctccacttctccggcctctacggcgagatcgccgatccggagaagtccgtggacggctacttcgcgaagctcagggaggaggccgccaaggacggcaagtccgaggtggcgctcgtcggcagcccgaaggcgatgtccccggccaacttcaagggcgccgtgatgaagtgccaggacatcaagttcacctcgaaggacacgacctccaaggggcccaaggaggccacgctccccttctgcgtctggggtgactacagcaccctgagcatgatcagcgcctcggacgtggcctccatcctcgcgaacaagcccggttacacccaggagcaggccgccgaactggccgcgaagctctacaacaccgcccgcgtcaagaagtaacggcgcgcgcggcacacgcagaaggggcgcccccggccgggggcgccccttctgcgtactgccctgtggctacgccgacttctcgtgcgggccctggtccttcgggacgatccgcgggaccagcgtcgggttgacgttggagcggaccacgtccgcggtgatgaccacgcgggccacgtccttgcgggacgggacctcgtacatcaccgacatcaggacctcttccatgatggcgcgcaggccgcgcgcgcccgtctggcggaggatcgcctggtccgcgatggcctcaagcgccccgcgctcgaagtccagctccacaccatcgagttcgaacagccgctggtactgcttgaccagcgcgttgcgcggctcgatcaggatctggagcagggcctcgcggtccaggttgtgcacggaggtcagcacggggaggcggccgatgaactcggggatcatcccgaacttcaccaggtcctccggcatgacctcctggaactggtcgctggcctcgatctcgcgcttcgagcggatcgtcgccccgaaaccgatgcccttggcgcccgcacgcgactcgatgatcttctccaggccggcgaaggcgccgcccacgatgaagagcacgttcgtcgtgtcgatctggatgaactcctggtgcgggtgcttccggccgccctgcggcggtacggaggcggtcgtgccttccaggatcttcagcagggcctgctgcacgccctcgccgctcacgtcgcgcgtgatcgacgggttctcgctcttgcgggccaccttgtcgatctcgtcgatgtagatgatcccggtctcggccttcttgacgtcgtagtcggcggcctggatcagcttcagcaggatgttctcgacgtcctcgccgacgtacccggcctccgtcagcgccgtcgcgtcggcgatggcgaaggggacgttcagcatgcgggcgagcgtctgcgcgagcagcgtcttgcccgagccggtggggcccagcagcaggatgttggacttcgcgagctcgatcgcgtcgtcccggccctgcgcgccgccgttctcgccggcctgcacccgcttgtagtggttgtagaccgctaccgagagcgccttcttcgccggctcctggccgacgacgtagctctccaggaactcgtagatctcacggggcttggggagttcctcccaccggacctcggaggtctccgcgagctcctcttcgatgatctcgttgcagaggtcgatgcactcgtcgcagatgtagacaccgggtcctgcgatgagcttcttcacctgcttctggctctttccgcagaacgagcacttgagcagatcgccgccgtcaccgatgcgtgccacgaggtgcttccccttcgcctgggagacgcctggttcagcgctcctggtgcctcatatccgacggtaccttgccgggggccccgtgcggggcccccttgacgtggttcacatctccgaatgcggggacgtgctcacgccaactggtggcaaggatcagaccgcgctgctcttacgggtggagacgatctggtcgatcaggccgtacgcgagcgcgtcctcggccgtcaggatcttgtcgcgctcgatgtcgtcgcggatcttctcgatcggcgtcgtcgagtgcttggccagcatggactccagctggtcgcgcatgcgcaggatctcgttggccgcgatctccaggtcggagagctgctcacggccggtgccaccggagggctggtggatcagcacgcgggcgttcggcagggccatgcgcttgccgggcgtaccggcggcgagcaggaccgcggcggcggaggccgcctggcccatgcagaccgtctggatgtccggcttcacgaactgcatcgtgtcgtagatcgccgtcagcgcggtgaacgagccaccggggctgttgatgtagatggagatgtcgcggtccgggtccatcgactccaggcacagcagctgcgccatgacgtcgttggcggacgcgtcgtcgatctgcacgccgaggaagatcacgcgctcttcgaagagcttcgcgtacgggtcgtactcgcgcacgccctgcgaggtgcgctcgacgaagcgcgggatgacgtagcggttgtccacctgcgggccggtgtagaggccgcttgcggagaagttgttctgcatctgggtgttcaccatcctggtggcgttctgcgggctgtcggctgacgggtactgacggtgggagcctggatcaggcacccgtgccgccgccgcccggcgcgttggacgcggccgagatgatctcgtcgatgaggccgtagtccttggcctcctcggcggtgaaccagcggtcgcggtcaccgtcgcggatgatcgcctcgacggtctggcccgagtggaacgcggtgatctcggccatgcgctgcttggtgcgcagcaggtactgggcctggatcttgatgtccgacgcggtgccaccgatgccggcggagccctggtgcatcaggatgtcggtgttcggcagggcgaagcgcttgcccttggcgccaccggtgagcaggaactgccccatcgaggcggccatgcccatgccgatggtgacgacgtcgttcgggatgaactgcatggtgtcgtagacggccataccggccgtcacggagccaccggggctgttgatgtagaggtagatgtccttctccggctcggcggccaggagcaggagctgcgcggtgatcttgttagcgatgtcgtcgtcgacctgctggccgaggaagatgatgcgctcgccgagcagccggttgtagacatggtcgccgaggccgccaccgatggacggctcacccgcggcgtaaggcttcagattcgtcacgtatccacctgctcgtctccgacggccatgtgccgtctcagcgtttcgttctggggtccggtccggacggagcggacgggtccgccggcgcccgggtactcacgtgccctcgtattcatggaccctaacgcgcaggtaggacaacgccatcccgcttccggaactgttcgctcggagcgcaagctccgggggccgtacggggcctgtgacgaagggcccggacacgacggtgtccgggcccttcggggcactgctcagcgggcttcgcccggggtgttacttggcctcttcggccttgacctcgtcgtcgccgtcgacgacggcctcgacggtctcggcggcctgctcctcgtcctcgtcggacaggtccacgacgtcaccgttcgtgtcgacgaccttggcggcctcgacgacgaccgcgagggccttgccgcgggcgacctcgccgaccagcatcgggacctggccaccctcgaccacggcctgggcgaactggtcgggggacatgccggaggaggcggcgcggcgcatgaggtgctcggtgagctcctcctggtcgacgcccagcttctccttgttgaccagcgcgtcgaggacgaactgggtcttgatgcccttgatggcctgctcggaggtctcggcgtcgaactcctcgaccgtcttgccctggaactccaggtacttctcgatggtcagacccatctggccgagctggtggtgctccaggttgtgcttgcgggtctggacctcgtccgcgaggagcttctcggggatcgggacctcgacgagctccagcagcttctccaggacgcgctcctgggcctgcgtggcctggtcgtactgcttcatgttctcgaggcgcttgcggctgtccgccttgaggtcctcgagggagtcgaactcgctcgccatctgcgcgaactcgtcgtccagctccgggagctccttggcggagaccttggtgaccttgacggtgacctcggcgtccttgccctcggcggagccgcccttcagctgcgaggtgaaggtggcctcgccgccggcctccaggccggtgacggcctcgtcgatgccctcgaggagctcgcccgagccgatggtgtaggagacgtcggaggcgacgccgtcgggcagcacctcgccgtcgaccttggcctccaggtcgatggtgacgacgtcaccctcggcggcggcgcgctcgacgtccttggtggacgcgaagcggccgcgcagctgctcgacggacttctcgacgtcctcgtcggagacctcgatggcgtcgacctcgacctcgatgccggagaagtccgggatctcgatctcgggacggacgtcgacctcggcggtgaaggcgaggacctcaccgtccttgagctcggtgatgtccacgtcgggctggcccagcgggttcaggtcggcctcgttgacggcctcggtgtagaacttcgggagggcgtcgttgacggcctcctccagcaccgcaccgcggccgaagcgctggtcgatgacgcgggccgggatcttgcccttgcggaagcccttcaccgtgacctgctggttgatcttcttgtacgccgcgtcgaggctgtccttgagctcctcgaagggcacctcaacagtgagccgaacccgagtcgggttcagggtctccacggcgctcttcacggttcggtctccttgtggctgactgctggggattctgccgtcgcgctgtgattcagcggttcggcggacttcggcccggtacatcagacacacgggcacgcagcttgcatagtaaccgcaagcggcaatcagcccacaacgcgatcttgtggagacactgctgttggtcggggtggccggattcgaaccgacgaccttccgctcccaaagcggacgcgctaccaagctgcgccacaccccgtcggtgcgacacgtagggtacatgcctggagacactctgatgcgcggggtttcccgagccgtttcgggatgacctccggcgaggcgccgaatgtggtgtgcacccaccgggagcgacccgctaggatgctgtccgtgcccaggtccgcggacctgcggcgcgtgcgttgcgggtgtagctcaatggtagagcactagtcttccaaactagctacgcgggttcgattcccgtcacccgctctcaagcacgaagggccaggtcagaggatgtttcctccgcctggcccttcgtcgttcccggggctcgcgacaccacacccctagtacgggccgccgcggaacagcaggctgccgtggtggcgcgggcggtcgccgcgctcgtgggcggcgtcggagcggtcggcgggcgccaaacgcccggcgagggtgcgcagcgcggccaggccggccagcacctcttcgcggcggtcggcggacttcatccaggccggcagccgcgcgaacatcgccatcgtcggggaggtgtgacggtggcgcagacgggcgcccacgtaggcggcgagggcgtcgacgtgctcttcgtcgtaggcccacaggatccgtcccgcacaacgggtctgaagccacaacggccgccggaagaaggggtcctcggtgccgccgggcaccgcacccaccaggcccgcgccccgttcctcggtggtccaggccgcgaccgcgccgcagccggcgcagacgagacggcggggctggaagagcagggcactgaagtacttcggcggcgcgaggtccggccgggggacgacgagcgcacggccaccgcacctcgggcacaccacgaggatccggctggtgaactggacgagccacgtgccgtggtcgtggtggcggaccggttcgccgtcggcgggctcggagctcatggtcagagcttgatgttcgcgatcatcgtcgcgagggagttcaggaagcggttcacgtcgtccgcgatcgagctggacgcgaggaagaagccgaagagcgccgcgacgatggcggggcccgtcttgatgtggttgccgcggatcagcaccaccaggatgaccgccaacagaaccaccactgacagcgaaatggccactactgatcacaccttcggtcgtcccctggtcggcccgggggcacggccaggcatacccccacatggaccatcctcccaccaacggaccccggctatacgccccgtgacgaatagccgtgattccgtttccgccaaccacaggcgcgacaggaaactttcgggcgcggggcgcccgtcacggggcggtgagaccgaggagggaacggatattcgcatactttacggacagccgttcgcgcgtgggcccgtccagcacggagaggcgtacggggtccgcgttgtgcgcgaggtcggcctccttgacgagcagggcgcccggggtggccaggatgcgggccgcgtacagctcgacggcttcgcccgggcgtttggtgaccgcgaggaccatgtccttcaccgtctgcgggagggccgccgcatccagccaggtgaggctgagcgcctcgtcctcgatggcgtcgtggagccaggccgccgcctgctgttcgggactgccgccgcgcagccgtacgccctcggccacggccgcgaggtgttcggcgtacggccggccggccttgtcggtctggccctcgtgcgcgtcgcgcgccagggactcgacctcgatcagagtcagggggctgttcgtcatgcgatctcccttgccgctgcgccgagagcctccgctgcccggcgtacgtccgcctgcgtggtacgccagttggagaacgcggcgcgcagggcggcggttcccccgtagacggtgggagtgacgaagacctccccggccaccgcctcgcgcaggactgtgaggcgctccggggtgggggcctcggcgagggtgaagcagacgacgttcaggcggacgggggccagcagggtgaaggcggggtcctcctcgagggcggcgcccagcgcgcgggcgcaggcgatgtcccgttcgacgatctcccggtggccctggcggccgtacgcgcgcagggtgaaccaggcggagagggcgcgcagccggtgggagttctcgggggtgaggtggacgaggtcggggtgttcgccgagggggcccaggtaggcggcggagttctggaagacgcgggcctgcaggtcgcggcggcgggtgaactggacggcgctgtcgtaggggacgttgagccacttgtgcaggtcgacgcagacggagtccgaggcgtcgaggccgtcggcgagatgggcgtgcgccggggagagggcggcgaaggcaccgaacgcggcgtcggtgtgcagccagaagtcgtggcgcccgcgcagggtttcgatcgctcggaggtcgtcgaagtcgaccgtgttgacggtgcccgcgttggcgacgaccacggccggtcccggggtgtcggccagcgcccgttccagggcggcggggtcgacggcctcgcggcccggcagggtgggtacccggaccagggagttgcggccgaggccgaggaacgaaagggccttggcgatcgaggagtgcggggcgccggagagcacgcggaccgggccgagggccgccgcgccgtcctcggccggggagacgccgaggcgttcgccgagccattcgcgggcgatggcgaggccggtggtgttggacatggtggcgccggagacgaaggttccggagtggtcggcggagaggccgaagaggtcgcgcagccagccgacggtctcgcgttcgaggtcctggccgccgccgtcgaggacggagttggagttctggtcgtggacggcggtgagccagtccccggcgagggcggcgggggtggcaccgcccgtgacgaagccgaggtagcgcggtcccgcggacgccgacagccggggctcccagcggtctcggaaggcggcgagcgcggcgtccgtgccggcggcgtgttccgggaggggttcggggtcgtgcggctttccggcgggcggtacgacagggcgcgcgtccagggtggcgagcgcgtcggcggcggcgccgcgggtggcgtcgaggagttcggggagccgggcgaggtcggcggcgagcgtgcggtccatgggggcacgttaggcgcgtccggggccgagggggcgggccaatcggcggggagtggcccgccgtggcgtcgtaggctcaccggatgatcgcgaagcggtggatgaggcgatggataccgggcctgctcacggcgggggtgctggcgggggcggcgggctgctcgacgcccccggccccgcgggcggcgcccgggccgaccgcggtgagcgtgacggccgggcccctacccgccaggagtgcgcccgcggcgccaccggccacggcggagccctgcccctcgggcggggtccggctcgtcgagatggaggggaacgcggcgatggggctgcgggtggcggacttccagctggtcaactgcggtgaccagccgtacgccctggagggctacccgcagctgtcgctgcgcgacgaccgcaacgacgcggtgccggtcgcggtggagcacggggcggccgggatcaccacgggcgcgtcgaacctggacgaggcgccgcggccggtgacgctggcgccggggcaggcggcctccttcgggatggtgtggcgcaacctcgtcaccgactcggcggtgccggccgccacggcgcggatcgtggaggtcgagccccggcccggtgcgccccggctgtggctgcggctcgccgcgccggtcgacctcgggaacaccgggcggctgggcctggggccgtggcgcccgatgacccgctgagccccgggcggctgcggcggccggcggccccgccggagcgggaggcgcgccggggttcaggcggccgcggcgccgtcggcggtgagtgtggccatccgggccgccacggccgcggcggagctgcgcggcaggcggtcggtgatcaggccgtcggcgaggaagagcacctggtcggcgtgggcggcggcggccgggtcgtgggtgaccatgacgacggtggcgcgcagggagtcgacggcgtcccggagcagcccgaggacctccgccgcggtggcggtgtcgagcgcgccggtgggttcgtcggcgaagaccacgtcgggccgggtgaccagggcccgggcgatggccacgcgctgctgctggccgccggacagttcggccgggcggcggccgcccttgccctccaggccgacgcgggcgagcagctcggcggcgcggtcgcggccctcgtgcgcggagcggccgccggcgagccgcagcgggagcagtacgttctgctcgacggtgagggacggcagcaggttgaaggcctggaagacgaagccgaggcggccgcggcggagttcggtgagctcgttctcgttcatggcggtgatctcggtgccgccgagccggacggacccctcggtgggcaggtcgagtccggcggcgcactgcaggaaggtcgatttcccggagccggagggtcccatgacggcggtgaagctgccgcgcggcaggctgaggtcgatcccgcgcagcgcgcgcacggcggagcccccgcgcccgtaggtcctccgtacgccgcgcagttccacggctgcggtggtgtcgtaccgttccggcggggtctgccggtgctgccgcctgctccgtcggagccccatggtgtgccgcctctcgctgccgtcctggtcgtggctccgacgctacggatcatggcgggccgacggccatgacgccgcccggcggaccggtggtggggcaatccccaccccctggtcaggcggagcggcggatgagcagcagtgcgcggtcgtcgttgacgtccttggcgaccttctcgatcaggtgccaggccgcgccttcccagccggcggcgacgtagcggtcggcctcgccggtgaggcggtcgatgccctcgctgatctcccggtcggcggtctcgaccaggccgtcggtgaagagcatcaggacgtcgccggggcgcaggttcccgcgggcgggagtgaattcggcgccgtcgtagacgccgagcagcgggccctcgccggtcttctcctgccagcggccggtgccggccgagagctggagggcggggaggtggccggccgagaggagttcgtagtcgccggtctccaggtccaggacgaggtggatggaggtggcgaagccctcgtcccagtcctggcggagcaggtagccgttggcggcgggcaggaagccgtgggcgggcagcgcgccgagcagcccgccgaaggcgccggagagcagcagggcccgggagccggcctccatgcccttgccggagacgtcggtcaggacgatctccagggtccggccgccgttggtgcgggccgcgacgacgaagtcgccggagaaggactggccgccggccgggcgcagggccatctcgcggtgccagccgcgcggcagggcgggcagtttgctctgcacgcggatgcgttcgcgcaggtcgaagagcatggtgccgccgcgccgccagggcacgccgacgcggctgcggaactgggcgatgagcaggccgaagaatccgcaggccgcgacgacgagcacggtgccgggggtgacgcgtgccggaccctgggtataagggcccagggcaagggcctcgacgatcagtgcggccgcggcggccgcgtacagggcgaggaggctggcggggcgcagcagcaggccgccggccacgatcggcaggacgagcgccgacggcgagaaccagacgggcagcatcagcgtgccgcaggcgatggcggggacggtgagcagcaggcctgcgaaggcgagccagtcggaggcgtcgccgcggaagtagtcgacggctgatttgcgcagggctgtgcggccccggtgcgacagcatgcgcatccgggccatgagggattccacgcgtgctccggccattgcttcgggaccttatccatcctggctgtggatgcgcaggggtacccccggacctggggtccacagacgcccgaaaacagatcgactgagtcggaatgccctgatagggatggccacatgactctggagatgcgcgtaatacagactgatgagtgggatgtctggtacgaccacctggaactggcattcggcggtgtacccgaatcccccgcggagcgggagctgtgcaaggcgttgacggacaccgaccgcgcgctcggcgtctgggacggcgacggctgcgtcggctcggccggagccttctccttccggctgtcggtgccgggcggggcgatcgtcccggcggccggtgtcacggcggtgggcgtctcccccacccatcgccggcgcgggatcctcacctctctgatgcggcgccagctcgacgacatccgggcgggtggcgaaccgctcgccgtgctgacggcctcggatccggcgatctacgggcgcttcggctacggcacggccgcctacgcgctggcggtggagatcgacacgacccgcgtacggctgtccgtgccgcccggcaccgacgggatccggctgcgcctcgtggacccgcggaaggcgctggccgactgcgagcgggtctacgcggcgctggtctccagccggccggggatgccggcccggcagccgggctgggaggagctgccgctgctggacgcgccgtcgatgcgcgagggcgggtcaccgctgaagtgcgtggtcgccgagcgggaggacggtgaggtggtcgggtacgcccgctaccgggtcaaggcggactgggacctgacgggttcggagggcaaggtcgaggtgagcgatctcgacgcgctggacccggtggcgtccgcggccctgtggcgctacctgttctcgatcgacctgacctggacggtacgggcgccccggcggccggtggacgacccggtgctgcacctggtgagcgacatccggcgggcgcggacgcggctccgggactcgctgcacgtacggctggtggacctgccggcggctctggaggcgcgggcgtacggggcgccggtggacgtggtcgtggcggtggaggacgcgttctgcccgtggaacgaggggcggtggcggctggtcgcggacgccgggggtgccgcgcgctgcacgcggaccgcggagccggccgacctggagctgtcggtccgggagctgggatcggcgtatctgggcgggatcaccctgacctcgctggcggcggccggcctggtgcgcgagctgcgtccgggcgccctgacggaggcctcgcgggccttcgccggggacgtggcgccgtggctgccgcacagcttctgacccgccggcttccggcccacccgcgtcagcgggactggcagccggggcaccagaagaggttgcgcgcggcgaggtcggcggtgcggatctcgccgccgcagatgtggcagggcatgttcgcccgccggtagacgtagacctcgccgccgtggtcgtcgacgcgcggcggccggcccatggcctcgggcaggtgctcgtcgcggacggtgtcgatgcggttgttgcgcacgccctcccgcatcagggcggcgaggtcggcccacatggcgtcccattcggaacgggtgaggtccttgccggcccggtacgggtcgatgccgtggcggaagaggacctcggcgcggtagacgttgccgacgcccgagacgatcttctggtccatcagcagggcggcgacggtggtgcgggaccgggagatccgggcccacgcgcggtcggggtcgtcgccgtcgcgcaaggggtccgggccgagccggtcgcttatcgcccgcttctcctcgtcggtgatccacgcgcaggtggtggggccgcgcaggtcggagaagtggtcgtcgttggccagccgcagccggaccgtgtccgtggcgggcggggccggcgccgggccgatcgcgtacttgccgaagagtccgaggtggatgtggatccacccgttctccttgaagccgaggaagaggtgcttgccgtgggcgtcgacgccgtccaggatccggccgtcgagcagggccgcgctctcggcgaaccgcccctgggggctgctgacggcgacctcccacccggcgaaccgctgcaggtggtcctgggccaggcggtggatcgtatgcccctcgggcacggcggcgctcctcgcatgctcgggtaaagaaaacggccgtgccgcccgtgtcacgggcggcacggccggacgcggctcagccctgcgggtggtgggccgggatcggggggagctcgccggtggtctcgtaggcggagagcatctcgatgcggcgggtgtggcgctcctcgtcggagtacggggtcgccaggaaggcctcgatgaagctgacggcctcgtcctgcgtgtgcatgcggccgccgacggagatgacgttggcgttgttgtgctcacggccgagctgggcggtctggacgctccaggccaggatggcgcggacgcccttgaccttgttcgcggcgatctgctcgccgttgccggagccgccgatgacgatgccgaggctgtcggcgtcggcggcggtcttctccgcggcgcggaggcagaacggcgggtagtcgtccaccgcgtcgtagatgtggggcccacagtcgacgggctcgtggccgttgttcttgagccagtccaccaggtggttcttgagctcaaagccggcatggtcggatccgaggtacacgcgcatgggacgagtgtggcacgaggaggcccgacagcccgcagcgggtgtcgcgtaagtcacttctaaagctcaagtaaacccaaagaacgcagatgggacagggcgggacggcgtcctggacgttcacaccaaggcaacgatccggattgaggtcttccgtcctgcgttcatctcaggtttgaatgccggggctcgcaacccgagaacctaaggatccgtccatgagctccacgacgacccttcagaaggaaggcggccccaccgggaaccccggtgacggccagccctccgacggtctgaaggccggtctcaagaaccgccacctgtccatgatcgccattggcggcgtcatcggcgccggcctcttcgtcggttccggtggcggcatcgccaaggccggccccgccatcctgatctcctacgcgctcgtcggcgccatggtcgtcttcgtgatgcgcatgctcggcgagatggccgccgccagcccgaactcgggctccttctcggcctacgccgaccgcgcgctcggccgctgggcgggcttctccatcggctggctctactggttcttctgggtcgtcgtgctcgcggtggaggccaccgccggtgccgccatcctggaaagctggatcccggccgtcccgcagtgggcctgggcgctgatcgtgatggcggtgctgaccgccaccaacctcggctcggtcgcctcctacggtgagttcgagttctggttcgcgggcatcaaggtcgtcgccatcggcgcgttcgtgatcgtcggcatgctggccgtcttcggcgtgctgccgggctcggacaacccgggcgcgggcttcgcgcacctcaccgacgccggcgggttcttccccaacggctacggcgcggtcctcaccggcgtcctgatggtcgtcttctccttcatgggcagcgagatcgtcaccctggcggccggcgagtcggagaacccccgcaaggcggtcacccaggccacgaactccgtcatctggcggatcggcgtcttctacctcggctcgatcttcatcgtgctgaccctgctcccgtggaacgacaagtcgatcaccgagaagggctcgtacgtcgccgccctggactcgatcggcatcgcgcacgccggcacgatcatggaggtcatcgtcctgaccgccgtgctgtcctgcctgaactcgggcctctacaccgcctcgcgcatggccttctcgctcggtgagcgcggtgacgcccccaaggcgttcgccaaggtcaactcccgcggtgtgccggtggtcgcgatcctgggctccacggtcttcggcttcgtcgccgtctacttcaactacgcgttcaaggacacggtcttcaacttcctcctgaactcctcgggtgccatcgcgctcttcgtctggctggtgatctgcttcacccagctgaagatgcgcgggatcctggtccgcgaggccccggagaagctgaccgtgaagatgtggctgttcccgtggctgacctgggccaccgccgccctgatcatgttcgtgatcggctacatgttcgtggacgacgccaaccgcgaggtcgtcaccctgtccaccctggtcgccggcgtcgtcgtgctcgtcggcgtggtgctggacctccgccgcaagaaggccctgcagggctgatcgcacgtgcacgtacgccggagcccggcccgcctccatgaggcgggccgggctccggtgcatatcgggggtggctcagccgcggcggccggccagcttccaggcggccggcagggcgcccatggccagcgcggccttgagggcgtcgccgatcaggaacgggaccatgcccttcgcgagggcgacgcccagggacatgccggtggcggccatcaggtacggcacgcccaccgcgtagatcacggccgagcccagcaccatcagaccggccgtgcgcagcacggagcggtcgccgccccggcgcgcgagggcgcccacgacggtggcggcgagcagcatgccgagcacgtagccgaaggaggcgccgcccgctccggaggtcccgcccgcgaaccacggcacgccggccatgccgacgagggcgtagagcgccagcgacaggaagccgcggcgggcaccgaaggcggtgccgacgagcagcgcggcgaaggtctgaccggtgacggggaccggggagccggggacgggaaccgcgacctgggcggccagcccggtgagcgcggcgccgccgacgacgagcgcgatgtcgcggacgcggctcgcgggcagcagatcggcgaggacggcgccgggacgcagggagacggaggcagtgctcatcagggggctccacgggatgggggtggcgggacgatcaccgacgctagtgcgcggtccgccgccgccccaccgccgcccgagacaaagccccactccccgctttggtggggatttcacaaaccctgcaccccacacccgagtcggcgtgatcctcgtcacgaggaagatcagacagcacgtcctttttgcacggacgaccgccgctcagtgagactgtaggatcccgccaatcctgacgcggggctcccaccgccactgggcccgaacgagagtacgagcacccttcatgcgtgagcgcctggaagaagcacctcccaccgggggcgatctgcccgcggaacccctcagccacagcctcaagcagcgccacctgaccatgctgggcctcggcggcgtcatcggcgccgggctcttcgtcggctccggcgccggcatcggcatcgccggtcccgcgatcatctgctcctatctgctcgcgggcgtcctcgccatgctggtgatgcgggcgctgggcgagatgtcggccgcgatgcccgcctcgggctcgttctccgtctacgcggagcgggcgctcgggcgctgggccggcttctcggcgggctggctgtactggttcctgctggtcgtggtgctggccgtggaggccaccggtgcggcgaagatcgcgaacggctgggtgccctcggtcgaccagtgggtctgggtgctgctcttcatggtggtcttcaccgtgagcaacctgaccgccgtgaagaacttcggtgagttcgagttctggttcgccgcgctcaaggtcggcgcgatcgtgctcttcctgatcctcggcaccctcgcggtcttcggcctgctcccggacacggagccggtcggcatggccaacctcaccggccaggggggcttcttccccgagggcttcggcggcgtggtcgcgggcatgctcgccgtcatcttcgccttcggcggcctggaggtcgtcaccatcgccgccgccgagtcggacgacccggcccggtcggtgtcccgggcggtgcgcagcgcggtgtggcgcatcctcttcttctacgtcggctcgatggtggtcatcgtgaccctgctgccgtggaactcgctgaagccgggcgagagcccgtacgtggccgtgctcgactcgatcggcatcccggcggccggccagatcatgaacatcgtggtgttcgtggcgctgctgtcggcgctcaacgcgaacctgtacgggtcctcgcgcatggtgttctcgctggccgagcgccgggaggcgccccaggcgctgctgaaggtctcgggcggcggggtgccgcgccgcgcggtgttcgcgtcggtggccttcggtttcgtgtcggtggtgctcaacctgctgtggccggacacgatcttcctctacatgctcaacgcggtcggcgcggtgctgctgttcgtgtgggcgctgatcgccgtgtcgcagctgaagctgcgccgccggatcgagcgggacatgcccgagcggctgaccctgccgatgtggctgttcccgtacgcgacctgggcggcgctgatcgggatggcggcggtgctggtcctgatgctgttcgacgatgcggcgcggccccagctgctgtggtccacgggcgcggcggcgctggtcctcgtggtggccttcgtacgggagcggcgcaccccgaagtcctgaccggccggctctccacgaccccggcgaaggccccccgcacacccggcgcggggggccttcgcgcgtcaggtgcgcaggtacgaggctccgttgacgtcgagcacggtgcccgagctccagcgcgcggcgggcgaggccaggtgcagcacggcggcggcgatctcctgcggggtgcccacccggccgaaggggctctgcgcccggatccgctcgccctcctccccttcgagccgcccggcgacccgctcggtggccacgaagccgggcgccacggaggccacggcgatgccgtgcggggccagggagacggcgagggactggccgagtgcgtgcagggccgccttggtggcgccgtaggcggggtggtcgggctcgccgcggaacgctccgcgcgagccgatgttgacgacacggccctcccgccggccggcgatcatgtggcgggcgacgcagtgggtgaggttggccggggcgaagagattcacggcggccgtctgccgccaggcctcctgccagtcggcgtacgaggtcgtgggcagggggtgcgcgaccatcacggcggcgttgttcacgaggacgtcgacgccgccgagcgcctcctcggccccggccgcgagggcttcgacgcgggccgggtcggcgaggtcgccgctgacgaggacgtggccctcgcccggcaggtccgcgagggtgcgctcggcgtcctcatgccgcgaggtgcagtgcaccgccacccggtcgccccgctcggcgaaggccgtggcgatggcccgcccgatgccccgcgaggccccggtgacgagcaccccccggcccgtggcggccagttcccgtatgccgtggtccgttccttcgtccaccggtccccctgtcgtcgcctcgtgcgcgtcctgcctgcagcgtacggggatgatcacggccggtcatccggccgtccgcatatcggacgtcgagcatccgaagatcggacagaggtgagactggggcacctcatcacgtccacccgcacaaccggacaggcacaccccaatgagtcagagcaccctgacacctcccgaagcaccgcagaccggcggcggatccccgctcggcaacggactcaagcagcgccacctctcgatgatcgccctcggcggtgtcatcggcgccggactcttcgtcggctccggcgcgggcatcgcggccgcgggcccctcgatcgtgctcgcgtacgccgcgtccgggctgctcgtgatgttcgtgatgcggatgctcggcgagatgtccgccgccaaccccgcctccggctccttctccgtgcacgcggaacgggcgatcggcccctgggccggattcaccgccggctggatgttctggaccctgctctgcgtgggcgtggccatcgagggcatcggcgcggcgcacatcatgaccggctggttcccgggcaccccctcctggatgtgggtgctggtcttcatggcgctgttctgcggctccaacctcgccgccgtctcgaacttcggcgagttcgagttctggttcgccgccctcaagatcggcgcgatcgcgctcttcctgggcctgggcgtgctggccgtgctcggcctgctgcccggcaccggctcccccggcaccgccaacctgctgcccgacggcggcttcctcccccagggtgtggacggcctgctcgtcggactgctggcctccgtcgtcgcgtacggcggactggagacggtgaccatcgccgcggccgagtccgagaatccggtcgagggcgtggccagggccgtgcggaccaccatgtggcggatcgcgatcgtctacgtgggctcgatgctggtcatcgtcaccctcctgccgtggaacgacccggccgtcacggccgacggcccgtacgccgccaccctggaccgcctgggcatcccggcggccggcgagatcatgaacgtggtcatcctgatcgccctgatgtccgcgatgaacgccaacatctacggctcctcgcgcatggcctactccctcgtctcccgcggccagggtccgcgggcgctgggcaaggtcagcggccgggtgccgcgccgggcggtcctcgcctcctgcgggttcggcttcgtcaccgtgctgctgtcctactggtacccggacaccctgttcgcctggctgctgaacatggtgggcggggtcatcctggtcgtctggggcttcatcgccgtctcgcagttcgtgctgcgccgccggctggagcgcgaggcccccgggaagctggtcgtgaagatgtggggcttcccctatctgacctgggtggcgctggccggggtggcgggggttctggtgctgatggccctgggcgaggacacgcgcgtccaggtgatcttcaccggcgggctgaccgtcgccctcgcggcgaccggttacgcgatgcagcgccgggcggccgcccgggcctgacggctcatcggaagacgaaggcgggccccgtgcgaaggcacggggcccgccttcgccgttcggaggcaacccttacgtgtggcctggaatagatactgctagcgtgcagttgcgcattgattgcaataagcagttggcacgctgaggggaccggataacacgcatggccatctacacgcttcctgagcttccgtacgactacgcggcactggagccggtgatcaacccgcagatcatcgagctgcaccacgacaagcaccacgcggcctacgtcacgggcgccaacaacacgctggagcagctggcggaggcgcgcgacaaggagaactggggcgccctcaacggcctggagaagaacctcgcgttccacctctccggccacatcctccacagcatctactggcacaacatggccagcccgaagaccggcgagggcggcggcgagcccaccgcggccgacggcctgggcgacctggccgacgcgatcaccgagtccttcggctccttcgcgaagttcaagaagcagctcaccttcgcctcctccgccacccagggctccggctggggtgtgctcgcgtacgagcccgtcagcggccgtctgatcgtcgagcaggtctacgaccaccagggcaacgtgggcgtggccagcaccccggtcctggtcttcgacgcctgggagcacgccttctaccttcagtacaagaaccagaaggtggacttcatcgaggccatgtggaacgtcgtcaactggcaggacgtggccaggcgctacgccgacgccaaggcgaacaccccgctgctgatccccgccaagggctgatcgcaccgccacaagcccgtccgcctcgtgatcgtcttctcaaccttcaccggcgggcgtgtcgaacggaagacccccgtgaggacgtgactcacgggggtcttctgtgtggtgcgccggccgggccggcgggtccgcctactcgaaggacggacccttggtacgggtgcgcttgatctcgtagaagcccggggtcgaggcgacgagcagggtgccgtcccagagccgggcggccgcgtcgccgcgcggggtcggggtgacgaccggaccgaagaaggccacgtcgccgtcggagcccggaacggagatcaccggggtgccgacctcctggcccacccggtctatgccgtcgttgtgcgaggcccgcagcacctcgtcgtactcgtccgagtcggcgtacgcgagcagctcggccggcaggccgacctcggccagcgcctcggcgatcacctcgcgggtcgggcccttctcgtcgttgtggatgcgggtgccgagcgcggtgtagagcttgccggtgacttcctcaccgtgcttctgctgggcggctatcaccacgcgcaccggggcccagcccttggggccgagcagctcgcggtagacctcgggcagctcgtcgagcttgttctcgttgagcaccgcgaggctcatcacgtgccagcggacctcgacgtcgcggaccttctcgacctcgaccatccagcgggacgtcatccaggcccaagggcagagcgggtcgaaccagaagtcgaccggggtcttctcgcgcacctgggtgtcggtcatgtctctcctcagtctcggcatgggtcgcaaaagggcggtaccgggctcacgttccccgactccaaccaggaccgggtgacgcgcattccctcgtgcgaggattcgacacaagaacgcgatcacgcacgaaggagtgcacgtgcccggtgagaatctgtcccgcgacgaggcccgtgagcgggccgagctgctgtccgtcgacgcgtacgaggtggtcctcgacatccggtccgcagtggacgaggccgaaccggccgagggcccgcggaccttccgctcggtcacgacggtccgcttccgggcggcgggcgccggcacctccaccttcgcggacctgatcgcgccctcggtgaacgccgtgaccctgaacgggcgcgcgctggacgtggccgccgtcttcgacggcgcccggatcgccctcgacggcctggccgccgagaacgtcctcgtggtcgacgcgaactgcgcgtacagccggacgggcgagggcctgcaccgcttcgtcgacccggaggacggcgaggtctacctctacacccagtacgagccggccgacgcgcggcgggtgtacgcgaacttcgagcagcccgacctgaaggccccgtaccgcttcgaggtgacggcgcccgagggctggcgggtgtggagcaacggcgcggaggagtcccgtgaggcgggcgtctggcggttcgcggagaccgcgccgatctccacgtacatcacgtgcgtggtcgcgggcccctaccactacgtgacggactcctacacgcgcggggacctgaccatcccgctgggcgcgatgtgccgcaaggggctggcgaagcacttcgacgcggacgacgtcttcctcgtcaccaagcagggcttcgacctcttccacgagatcttcgactacccctaccccttcgggaagtacgaccaggccttcgtgccggagtacaacctgggtgcgatggagaacccggggctggtgaccttccgggaggagtacatcttccgcggcaaggtcacgcaggcctcgtacgaggcgcgcgcgaacgtcatcctgcacgagatggcgcacatgtggttcggcgacctggtcaccatgaagtggtgggacgacctgtggttgaaggagtccttcgccgacttcatgggctccttcgggctggtcgaggccacccgcttcgaccaggcgtggatcaccttcgccaaccgccgcaagtcgtgggcctaccgcgccgaccagctcccgtccacccacccgatcacggccgacatccgtgacctggaggacgccaagctgaacttcgacggcatcacctacgccaagggcgcctcggtgctcaagcagctggtcgcctacgtgggccgggaggccttcctggagggcgcccggcgctacttcaaggccaacgcctacgggaacacgacgctcgacgacctgctgtcggtgctcgcggaggtctccggtcgggacatggcccagtggtcgcgggcctggctgcagaccgccggggtgaacgcgctgacccccgtgatcacctacgacgcgggcggccgcgtgacggaactggccgtcgtgcaggagggtgacgagctgcgcccgcaccgggtcgcggtgggcctgtaccgactggagtccgacgggaccctggtccgctacgcgcgggccgacgcggacgtgtcggacgcgcggacggtcgtcacggagctcgccggcaccgagcggcccgacctggtcctggtgaacgacgaggacctcacctactgcaagatccgcttcgacgagggatcgctggagaccctgcgggcgcacctcggggacctgacggacccgctcgcgcgggccctgagctggtcggcgctgtggaacctgacgcgcgacggcctgatgccggcgcgcgacttcgtctcactggtcctcgcgcacgcgggccgggagagcgacgtcggcgtcctgcagatgctgcacacgcaggccctggcctcggtcacccactacgcggcgcccgcctggcgcgagcagggcggccgggagctggcggcgggcgcgttgcacgagctgcgggtcgcggagccggggtcggagcaccagctgacgtgggcccgcttcttcgcggcgagcgcggcgagcgagggcgacttccagctgctgctggggctgctggagggctccgcgcggatcgacgggctggaggtggaccaggagctgcgctgggacttcctgctgccgctggccgcgcacggggcggtggacgaggccgtgctcgccgccgaactggcgcgcgacgacacggcctcgggcaagcggcaccaggtgcggtgcctggcggcgcggccctcgcaggcggtgaaggaccaggcgtgggcggcggtggtggagtcggacgcgctgtccaacgcgctggcggaggcgacgatcgcgggcatgcagcagtcctcgcagcggggcctgctggcgggctacgcggggcgctacttcgaggtgatcgagcgggtgtgggcggaccggtcgatccagatcgcgatggacgtggtgaggggcctgtacccgtcgctgcagagtgactcggtcacgctggaggccaccgacgcgtggctgtcggcccacccttcggctccgccggccctgcgccgcctggtactggagtcccgggacgacctggcccgggcccttgccgcgcagcggtgcgacgcgacggccggcaactagcccgcggcgccgtttcccggggctccgccccgggaaacggtgccgggccgggtaccccacacgggcgcaccccatcggcagtcgaacgcccgtactttagccccagcttgtccggatttgtcgacgagcgtgtaacaggggttagcgaggccgtggcctgagggaatcaccgcgtcatgaaccacaacgcacccctccccctcgcgcacctcaccggcagccgcccccgcgtgctgaccctcgcccagctgcgcgagcacggcgtcaccgcctccgacgcggccgggcggccctggcagcagatcctgcccggggtgttcctgctccaccccggccccgcgaccagcgaggagcggctgcacgcggcgctgctgtacgcggggcggcgcggcggcggcgaggccatgatcaccgggctggcggcgctcgccctgtaccggttcagctccgcgcccccgctgctcgccctctcgcacatcgacgtcctggtccccggcacccggcggctgcgttccaccggggacgtgcggatcgtgcggacgcacaccccgccgcggtcccaggaggtgaccggactgccggtggcgcccgtcgcgcgggccgtcgccgacgccgtcacccagctctccgacgcgggcaccgtacgccgcctgctgagcgaggccgtccgcagcgggcactgcgaaccggccgccgtcgtgcgggagctgacggtggcccggctgctgaaccggccgcacgtcgtcgacgcggtcgagtcgctgctcgcggaggggcgggccatcgccgaggaccggctgtaccacgtcgtacgcggctacgagctgcccgacccggtctggaacgtggacctgcggctgcccggcggcccccacctcggcggggtcgacgcgtactggcccgagcacgccgtcgccgtggagatcgacacccgcgccccgcgccagggcgagaacgagcagtggtccgagtccgtgcgcaagcgcgagacgctggagcggctcggggtgaccgtcatccacatcaccccgcgcaagctccgcgactggcccgagcagcaggccgcggtcatccggaccgccctgaccgcctccgacgaccgggagcccgccgcctacctggtggtcctgcccaggtgaggcgagtactccggggtgctccagagcagccgccccgggtgcacgctctccaccaccgactccacccggaagcgggtgcggcggctcccgccggccccgaactccgtccgggcccggccgctgagctgaaggaccgccccgctctcccagtccgggaagagcagcccggcccgcggatcggcggtcaggttccccagcgtcaggaacatggcgttgcccgcgtagtccggccaggccagctcgaccggcgagagcacctccacgaagcccggcagcccgccccggtggctggcgtcggccccgtccgcctccgccgtggtggcgacgaagaaggtgtcggcgtcgcgtacggcccgctgctgggcgccggtcagcgccctgccgcgccgcacgacgccctgcccctgccgggcgagctccagcggctgtcgcctctgcaggtacttcgggcagttggcgaagacctgttcggcctcgacggcgaagcccgcccgggtcacctcgacggttccgttcagccgcatccggcgccgggtgcgcgggtcgagcgcgatggccccgaccctggtcccggccgtggccagggcctcggcgagcgggtcgcccgccggtggaccgccggcgaccgcgatccggtccggcccggtggcccgtacgaaaccgggcggggcggtgagcagggaggcccacatccgccccgcaccgtcggcggcgccgacgaccaggtgcggctggagcccgaggaaggccgcggccgcatcgccgagccccgtaccgatcgagcgcccgacatgctcggcggcctcccgtacaccgacccgctcctgcacggccagcactccccggtggtacgccccggacatcggagaacccttcccacgatccaatctaacctttcacctccaggttaaaggttaggcactgctgcgtcaaccgctcacgtacccttgaggggttagccatccggcgagaggggcgagaaggacatgacggcggcggacccacgacccctgaccggggagccggtcgccctcgacctgctcaacacgcgctgggtcgtcgacggcgaaccgctggacctcttcgccggcgccgccgggctcacccgggtggaggggctcgcggtctggctggagagcaccggcctggccggccgcttccgcgccgacgcggccaccctcgtccacctgctgaccgcccgcgaggccctggcccgcgccgtcgcggacccggccgacgagagcgcccgcaccctggtcgacgccgtgctggagtacggccgcatccgcgccaccctgaccgccgaaggcccgggcgagcgcgccgaattcgccgatccggcctgggggccggcctggacggcggcgcgcgactacctcgacctgctgagcgccgcgcccgaccggatccgcacctgcgcgtccgagacctgcgtcctgcgcttcttcgacgtctcgcgcaacggcacgcggcgctggtgctcgatggccgcctgcggaaaccgggcgaaagcctcgcgccactacgcgcgcacgcgcgagcgctgagcactcgaaatctgtcacacccgcaccggggcggccctgcgtcccggtgctgactcagggccgccaagtcgacaaatagacccctcagcccctgcggttcgcaccactgtgccccggtaaggccccgctggcgtattcctcgcgctggcgagagtccgccatgacaggtctcggtcaatgacaactctccccaaagagctgtcgcttaggccaagctgaccggtcatccggcaccgaaatccggaccgtatctttcacttaccagggatgctgatgaccctcgaatcccccagctccatacccggggccagacgcgtcgcgcgcgtcgcggccgcggccggtctggtcgccgctctcgcggccaccggcgccggtcccgtcttcgcggcgaccggcgcggacaccccgggcacctcgcccgcggtcaagtccgccgagcagaagctcggttcggccgacgccgaactgcttcagcaggccaaggccaagggcgacgcgaacgtgaccgtcatggtcgcgacggcccccggccagaccaagcaggtggccgaccagctgggcgccgtacagggcgcctcggtgggccagacgtacgacaagctcggctacgtccgcgccaccctgcccaccggcaaggcggacgccgcgctgaaggcggccgccaagctgtcctcggtgcacggcatcgacctgcggcacgagatccagctgccggacccgcgccccgacgccgaccggtcggccggcgcggtcaagaagaccgccgccgagacctacccggcgccggacaagaacacccccgcgaagaacccgtacaacccgtccttcgagaccggtgcggtcgacttcgtgaagaacaacccgcaggccgacggccgcggcgtcaccatcggcatcatggactcgggcatcgacctcggtcacccggccctgcagaagaccaccaccggcgagcgcaagatcgtcgactgggtcacggcgaccgacccgatcacggacaacgacgccacctggcgcgcccagatcaccccggtcacctccgccggcggcaccttctccgcgggcggccagagctggaaggctcccgagggcagcttccagtggagccgcttcagcgagtcgatcaccgccaccggcgacatgaagggcgacgtcaaccgcgacggggacaccaccgaccggttcggcatgctctacgacgcggcggccggcaccgtccgcgtcgacaccgaccaggacggcgacttcacgaacaacgagccgatgaagccgtacaaggacggctaccagatcggctacttcggcacggacaacccggcgaccgacgtcgccgagcgcatcccgttcgtgatcgagatccgcaaggacgtcccgatggacccgctgggcggtgactgggtcggcaagaaggccgacttcgtcaacgtcggcatcatcgagtccgagcacggcacgcacgtcgcgggcatcaccgccgcccacggcctgttcggcggcgcgatgaacggcgaggcgcccggcgccaagctcgtctcctcgcgcgcctgctcctggtcgggcggctgcaccaacatcgcgctgaccgagggcatgatcgacctcgtcgtcaaccgcggcgtcgacatcgtcaacatgtcgatcggcggcctcccggcgctgaacgacggcaacaacgcgcgctccgagctctacaagaacctcatcgacacctacggtgtccagctcgtcatctcggcgggcaacgagggtcccggcgtcaacaccatcggcgaccccggtctcgcggacaaggtcatctccgtgggtgccgcggtctccaaggagacctgggccgccaactacggctccggagtgaccaagaagtacaacatgttccccttctcctcgcgcggtccgcgtgaggacggcgggttcacgccgaccatcaccgcccccggcgcggccatcaacaccatccagacctggctgcccggcgccccggtcgccgaggcgggctacaccctgcccgccggttacggcatgctccagggcacctcgatgtcctcgccgcaggcggcgggcgccggcgccctgctgatctcggccgcgaagcagcacaacatcaagctgaccccggccgccctgcgggtcgcggtcaccagctccgcgaagaagatcgccgacgtcccggcgcacgcccagggcgccggtctgatcgacgtccccgctgcgtgggagtccatccagcgcgacgccaaggcgaacgagttcaccgtcaaggcgccggtcgacaccgcgatcgaccagttcctgaagaccccgggcttcggcaccggcctctacgaccgcgagggcggcctcaaggtcggccagaagaaggtctacgacgtcgtcgtcacccgcaccacgggcgtcaagtacggcacccggcacgacctgacctggcgcaacaacgacggcaccttcaaggtcgtcggcggctacgactacgtcaccctgccgctgaacaagcccgtcaccatcaaggtcgaggccaacgccaagtcggccggcgtccacagcggcatcctgcaactggacgacgagaccaccgagggcatcgacaagcagatcctggccacggtcgtcgcctcgaccccgctggcgaagccctcgttcacgatgtcggacacctcctcggtgcagcgcaacagccacaagtcgtacttcgtcaccgtcccgcagggcgccaagacccttgaggtcgccctcggtggtctgaagccgggcagccagacccgcttcatctcgatccacccgtacggtctgggtgtcgaggacagcgcgacgacgcagtgctacccgaactacaacaacccggcgaacacctgccgtcccgaccttcgctcctacgccgacccgcagccgggcgtctgggagatcgaggtcgagtcgcgccgtacgtcgccgctgctggacaacccgttcaagctggacgtgtccgtgctcggcgcggccttcgaccccgcggtcaaggtcctgcccgaggtcaagcagggcaccccggcgccggtccagtggagcatcaagaacgacgccgcggccatctccggcggcaagctcaagggcggcccgctcggctcggcgaaggtcgccaagccgaccatcgccaccggtgagacccagaccaccgaggtcgccatcggcgagggcgtctcccgcctcgacatcgccatcggcaagacgtccgacacgggcgccgacctcgaccttgaggtctacaaggacggcgtcaaggtcggctcgtccgccgacggcgactccgaggaggccgtgagcctggtgaccccggccgcgggcacctacaccttcaaggtgatcggctacgcgatcccgtccggctccaccacgtacgactaccgcgacgtgttcttctcggccgccctgggctccgtccaggtcgacgaggccgccgcggtgaacctcgccaccggcgccaccgcgcaggtctcggcgaacgtcctggtcaacagcgcggcccccgagggccggcagttcttcggccaggtccagctgctcaacgcccgcggcaccgccgccggcaccggcagcgtgcagatcgagaaggtcctcccgtagcaccttccgcaacgaaacccgagggggcggcgctctgacgagcaccgccccctcgggccgttcccccggaccgtccccccggctcctccccctcggtcctacggcttgccgagcgaacgcagcgacccggcgtacgtgccgaccgcgtacgcgatcacgtccaggttggtgtcgaagaccttcaggtccacgttcttcagggtgtcccccgccccgtggtagttcgggtcgtacggggccccggccgtaccgccgtggcgcgcggcctgctcggcggtcttgacgccctcggcgccggtgaaggtgccgcccgccgggatgccgttggcgatgaacggcccgtagtcggaacggccgtcgaagtcactgccctcgtgcggcttgcccttcttgtcgaggaagccgttgatcagcgcctcgatccggtccgagcccgccggtcccgcgcccgcgcccgtccggtcggagtcgtccccgtcgtagacgaactgcaccgggttcggcgaggcgatcatgtcgaagttcagatagagcgcgatgtccttcttctgcttctcggacagctgggcgacgtagtgctccgaacccagcaggcccagctcctccgccgaccaccagccgaagcggaccttgttcgcgggccccttccccttcttgttggcgccctcctcggccagcttcagggccacctccagcaggccggccgagccggagccgttgtcgttgatgcccgggccctcggccaccgagtccaggtgggcgccgacggtgaccacgcggtcggagcggcccccgcgggtctcggcgatcacattgcgggtggtcttccgcacgtgctcctggtccagctccaggcgcacgctcacctcacccccggcggcggccgcggccagcgcctcgccgtcggccagcgtgatcccggcgctcgggatgatcccctcggcgggcgaggcgaacgtgccgcgtaccggggcggtgccgctgtggttgtagacgatcacgccgagcgcgccggcctcggccgcggcccgctgcttctccgcgaaggtgcacgcaccccgcttgaccagggcgatcttcccggcgaaggctccggccggatagtcgtcggcggtgcagccgggggtctcgtcgaccctggccggggcgagcggcgcggtcagcccgccggccggcgtggagggggtgaaggtgaaggcggcggtggccagctcgcgggagccggggccgaggacggtggtccgctccgtcctcgtccgcgcctcgtagatgtcgaagtcctggtacgagacctggtacccggccttcttcagcgtgtcgtacacgtaggcggcggaggccgcgtggccaggcgtgccggcggcgcggttgccgccgttcgcgtcggcgatctgctggaacttcttcaggtggcggtaggcgccctgggcggtgacctcctccaccagctccttggccagcccgccctcgcgcgggtgggcggccgccggcgtggcggccagcaggacgggtgcggcgacggtggcggccgcgagggcggcgagcaccggtatggaccggcggcggtggcgggtggcgcgcacggtggatctccccggatcgatggttcgttctgtggtccgccgtgtccggaaagcggacacgacagaccggacgctaaccggctccgaccaggcaaaacgggtgttcggaggcctggaaacgcgcctgccacgaactcgccacaggggttcacattcaggacaccgtccgcacctcggacaatggattggacaaggctcgtggggtcgaacgcatgatggcttcacgcgcgcccgcgtcgtacgtaccaaaggagtcaccgtgagggtcggaatcgtcggagccaccggacaggtcggcggagtcatgcgcggcatcctcgccgagcggaagttcccggtggacgagctgcggctgttcgcctcggcccgttccgcgggctccaccctcgaatgggagggccgggagatcaccatcgaggacgcttccacggccgactacgcgggcctggacatcgtgctcttctccgcgggcggcgccacctcccgggtgctggccgagaaggtcgcctcccagggcgccgtcgtgatcgacaactcctccgcctggcgcagccacccggaggtccccctcgtggtctccgaggtcaacccgcacgcgatcaagaaccgtcccaagggcatcatcgcgaacccgaactgcaccaccatggccgcgatgccggtactgcgcccgctgcacgaagaggccggcctgaccgcgatggtcgccaccacctaccaggccgtctccggctcgggcctggccggcgtggccgagctcaagggccaggcctgcgcggtctccgagaccgccgaccagctgaccttcgacggcggcgcggtggacttccccgagcccgccgtctacaagcgcccgatcgcctacaacgtggtcccgctggcgggcaacctggtcgacgacggctccttcgagaccgacgaggagcagaagctccgcaacgagtcccgcaagatcctggagatcccggagctcaaggtctccggcacctgcgtgcgcgtgccggtcttctccggccactccctccaggtcaacgcccgcttcgcgaacccgatcagcgtcgagcgcgcctacgagctgctgaaggacgccccgggcgtcgagctctcggagatcccgacccccctgcaggcggcgggcaaggacgcctcgtacgtgggccgcatccgcgccgacgagaccgtggagaacggcctcgcgctgttcctgtcgaacgacaacctccgcaagggcgcggccctgaacgcggtgcagatcgccgagctcgtggccgaggagctgcgcggctgatcacgcctccggcgcgaacgggagggcgggcgccgcacggcgtccgccctcccggcgcgtcagggcctgcgcacctcgaactggaagcagccgaactcggcggcgcggacgtgtacgagggccacttcgggctcggcgaaggcgtcggacagggcccgctcgatcaccccctcgggatcctccccgaggtccaggacccgccctccgaggatgtgcccgcgggcgtcgtagcgccgggcggtgcgcagcaccccggcccgggcgaaggggtatccgccggccgtgtccggcccggcgcaggtcccggcgtggatgaagacggggccctgctcgtcgtaggcgccgggatcggccccggcccgcgccgcccagcggcgcagcggcgcgtacgagacgagcgcgatccgctcccccgccgcgctggtccgcaggcagcaccgcagtggcgccccgccctccccgtcggtgaaggggacgcagtcgcgtcccgcgtcgtcgcgtacgcggagctcctggagcgccgtctcctcgatgggcctcgcccggtatctgctggtcatggccaccagcgtgccggggacggccaccgctgtccggcaggtttgcgacgtcgcgttcgcctgtggattagtccgaggcggtggcggtgtccggatggcaggatggccgggcaacgtcaccatcgaaggagatgaacgcgtgccaggcacgaatctcacccgtgaagaggctcagcagcgggccaagctgctgtccgtcgactcctacgagatcgaactcgatctcagcggcgcgcaggagggtggcacctacccgtccgtgaccaccgtgcgcttccagtcggccgggaccgggagcgagactttcatcgacctggtcgcgccgaccgtgcacgaggtcgtcctcaacggcaggtcgctcgacgtcgcggccgtcttccacgactcccggatcgccctgagcgacctggcggccggggccaacgagctccgcgtcgtggcggactgcgcctacacgaacaccggtgagggcctccaccgcttcgtcgacccggtcgaccagcaggcctacctctacacccagttcgaggtgccggacgcgcggcgggtcttcgccagcttcgagcagcccgacctgaaggcgacgttccagttcaccgtgacggcccccgagggctggaccgtcatctcgaactcgccgacgccggacgccgcggacgtcaaggacaacgtctggcgcttcgagccgaccccacgcatctcctcgtacatcaccgcgctgatcgtcggtccgtaccacgcggtgcacagctcctacgagggcccgaacgggcagtccgtgccgctcggcatctactgccggccctcgctcgccgagttcctcgacgcggacgcgatcttcgacgtgacccggcagggcttcgactggttccaggagaagttcgcctacgactacccgttcgccaagtacgaccagctcttcgtcccggagttcaacgcgggcgcgatggagaacgcgggcgcggtcaccatccgtgaccagtacgtcttccgctcgaaggtgacggacgcggcctacgaggtgcgcgcggagaccatcctccacgagctcgcgcacatgtggttcggcgacctggtcaccatggagtggtggaacgacctgtggctgaacgagtcgttcgcgacgtacacctcgatcgcctgccaggcctacggtgagggctcgaagtggccgcacgcgtggaccaccttcgccaactccatgaagacctgggcgtaccggcaggaccagctgccttccacgcacccgatcatggcggacatccgtgacctcgacgacgtcatggtcaacttcgacggcatcacctacgccaagggcgcctcggtcctcaagcagctcgtcgcctacgtcggcatggacgccttcttcaagggcgtgcaggcgtacttcaaggcgcacgcgttcgggaacacgcgcctgtcggacctgctcggcgccctggaggagacctccggccgcgacctgaccgcctggtcgaaggcatggctggagacggccggcatcaacgtcctgcgccccgaggtcaccaccgacgcgaacggcgtgatcaccgccttcggcatccgccaggaggcgcccgcgctgcccgccggcgccaagggcgagtccaccctgcgcccgcaccgcatcgcggtcggcctgtacgagctccaggacggcgccctcgtgcgcaccgaccggatcgagctggacatcgacggcgcgctgaccacggtgccggagctggtcggccgcacccgtccggcggtcttcctgctgaacgacgacgacctgtcgtacgcgaaggtccgcctggacgaggagtccctggccgtcgtcaccgcgcacatcggcgacttcacggagtccctgccgcgcgccctgtgctgggcctcggcctgggacatgacgcgtgacggcgagctcgccacccgcgactacctctcgctggtcctctcgggcatcggcaaggagtccgacatcggcgtggtccagtcgctgcaccgccaggtgaagctggccatcgacctgtacgccgacccggcgtggcgggagcagggcctggcggcctggaccgaggccaccctggagcacctgcgcggcgccgagccggcgggcgaccaccagctggcgtgggcgcgggccttcgcggccaccgcccgcaccgaggggcagctgacctacctgtcggcgctgctggacggcgcggcggagatcgagggcctggccgtcgacaccgagctgcgctggacgttcctggagcggctcgtcgcgacgggcgtcgccggtgagccggccatcgcggcggagctggagcgggacgccaccgcggcgggcgagcgccacgcggcgaccgcccgtgcggcgcgcccgacggcggaggccaaggccgaggcgtgggcctcggtggtcgagtccggcgacctgccgaacgcggtccaggaggcggtgatcggcggcttcgtccagaccgaccagcgcgagctgctggccccgtacaccgggaagttcttctcggcggtcaaggacgtctgggagacccgcagccacgagatcgcccagcagatcgcggtgggcctctacccggcgctccaggtctcgcaggagaccctggacgcgacggacgcctggctggcctcggccgagccgaacgcggccctgcgccgcctgatctcggagtcccgcgcgggcgtcgagcgcgcgctgaaggcccaggccgcggacgccgccgccgctcaggtctgacggctcgcaccgcagccggggctgcgccccggaccccgcgccccaatcgccgtcggggctggatttccagccccgcccggcgtttggggaccgggtccgggcggagccccgggaacgtacggtcagcggccggcggcgacggcgcgcaaggcggtcagcacgtgggacagcgcgggcgcggactcggcgccccggcggaccgccgcgatcacgtgccgggtcggacggtcgtgggtgaggacccggatcgtcccgcccgaggcgcggctcgacaccatccgggggaccagcgccacccccatccccgcctcgaccatggccaggatcgcggtccagccggacgccgagtgcgcctgttccgggacgaagccggccgcctcgcacgcggagcgggcgatctccgaccaggggccgctgcccccgtagatccacggttcgccggacaggtccgccagccgcagatcggccgcggccgccagcggatggcccggcgggagcgccacgtccagcgggtcctccatgagcgccacccgggtgaaccgggggtcgcgcgcggtcggcgcgtgcgccgtgagggacagcgccaggtccacgcccccggccgacaggagctcgtaggcttcggcggcctccgtctcccggacccggacctccaccccggggtgggtccgccgcagcgcggccaccgccgggaccacgagcgccggtacggccgtggagaaggcgcccacccgcacctcgcccgtgtccccggcgaggtatccggccagttccgcgtcggcccgctccagctgtgcgaacaccgcctccgtgtgccgcaggacgaggtgggccgcgtcggtgagccgcacccggcggccctccgcctccagcagcaccacgcccagttgccgggcgaggttcgtcagttgctgcgaaacggccgagggcgtcatgtggagcgcctcggccgccctggtcacggtcccctgttcggcgagggtccgcaggatccgcagcttcttgatgtcccactcggtcatgggcccgaacctaccgccgggcactccccagcccgactccgccgaggatgagcgccatgcagagcagctgcgccggtccggtccgctcgcccaggagtaggaagccgagcccggccacgcagaccggctggaggtagtagacgactccggcgcgcgccgcaccgatcatcgagacggccttgttccaggcgaagaaggcgacggcggaggagaacaccccgacgtacagcagcggtccgacggtcccggtggtgacctcgaagccgccctggacggcgacggagacggcgtagacgggggcgagcatcagcgcgccgagcacgaaggtggtgatcaggaaggcgagtccgccgagttcggcgggcttgcgccgcagcagggcgctgtacgtggcgaaggagagggcggcggcgaacatccacaggtccccggcgccgaagtcgaagccgatcgagccgtccccgaccagcagcagcaccccgagggcggcgaggaggatgccgaagctccgccgggctccgagccgttcgccgccgaggcgggcgtagagcgccatgatgaccggcgaggcggccatgatcatgcccatgctggaggcggaggtggtcagtccggcctggtgcacgagcgtgttgtagagggcgacgccgaacagcgaggcgagggcgatgaagccggagtgccgccggatcagctcccgctgctgccaggcctggcgggcggcgaagggggcgacggcgagcagggcgatgatccagcgccagaagaccgcctggacgggcgggacggtctcggccatgccccgggtggcgacgaagctgccggaccagacgaccgtcgcgagcagggcgaggagtacgccgagcccggcggcacccttcttccccgtgctgccgggcttggcttgcgagacggtacggacgcggtccatgacggccactgtgggtctgctcctcggagtgggctggtggtgtgtgtggactaccgtcgcactgcctcatccgtcaggtccatcgaaatgttctgatcgttcttttcaggagaactgaacgattggggcctgcgggcggcagccagctgaccggcgacggtggccccgaaggcgatcgccatcccgacgagctggaccggcgacagcgcctgcccgagggcggcccagccgatgacagcggcggtcaggggggagagcgggccgagcagggtgaccgaggtggcgctgagggcgccgatgccgcggaaccagagccagtacgcgatcccggtgttgatcagcatcatgtagccgtagccgaggaaggccttgccgtcgagcgcgggcggggcaccctcgacgagggcggcgacgggaatgatgaagagcccgcccgcggtgagctgccagccggtcatcgccagcgggcccacgccctcggggcggccccagcgcttggtcatcacggtgccggcggccatggaggcggacgagatcacaccggcgacgatgccgaccgcgtcgagccgggcctcggcggtcaggacgaccatgctcacgccgaacgctccgacgacggcggcgagcacggtacgcaggctcgcccgctccccgaggaccagcgcggccagtcctacgacgaacagcggtccggcggcgccgagtacggccgcgaccccgccggggagccggtacgcggagaggaacagcagcgggaagaaggcgccgatgttgaggatgccgaggacggcggacttccaccaccactggcccttggggagggtgcgggccagtgcggtcagcagcagtccggcgggcagggcccgcatcaccccggtgaacagcggccggtcgggcgggagcagctcggtggccacggcgtaggtcgagccccaggagacgggggcgagtgcggtcagggcgacggtggctaaacgcttcatggcgggtggctcctggatcgagaagaggaagcggaggcagggggcgggtagggctcaggcggcggcggtcacggcgaccggcgcaccggcggcctcgcggaccaccgggggctcggcgtgcacggccccggccggcaggtgccgctccaggcggagcagcgccagggcggcgccgagggccgcgacggccaggacggcccagggcaggcggccgtcgacggcgagcaggacggtgaacagggagggggcgagggcaccggccagcgagtaggacagctggtaggtggccaggtagcggccgcggacggcctcgggggcggcggagaccgacagggcgccgccggaggggctgtggacgagctcgccgagggtgtagacgacgacgatgaccagcagggcgatcagggtggcggtccggccggggcgcaccgtgccgagcacgatctgcccggcgaaggcggcggcgaagagcagggcgccgagcgcggccgagcgggtgcggcgggcgccggagcggcggacccggcccgcgatcagtacgccgatccccgcgcacagcacggtgttgacggtgaaggcggctccggtgagggagtcgggggccgccagccaggtggagaggtagagcgggaagaggacggagagggcggagtagcccagcgcggtgaggaagttggcggcggtgaggccgaggaagggccggtcgcgcaggaccgtccggtacccggcggatccggtggccgtggcgcctgccgcgccggccgcgccggccgccgggacctcccggaccgcccggacccggctgacgagcagtccggcgagggcgaaggcgagggagttgccccaggcggtgtacgtgaatccgccggtgccccacagggccagtaccccggagaccagcagggcgcccgcgcccatcccggcgttctgcagggcccgggtggacgcctggagccggtcgcgggcggcgccccgcgccacctcgccgatcagggactgctggacgacggagaaggaccggtcggcgagggcggtgacgagggcgacggccgcgaaggcgggcagggagctcgcgaaggggtagagggcgaagccgagcgcccgtgtcccgtagagcaccaggttgacccgcttggcgccgaaccggtcgacggccgtgccggcgagcggcatgaatgccagtccggcgagcccggtgaccgtcatgaccaggccgacgacggtgagggagaggccggtgacgtggtggaagaagaccagcgagaaggggacgtacataccgatcccgaccgcgctgatgccgattccgaggagcagcgaccgctcccccgcgaccttcgcttcccctgatacggccgtcttcctcatgaacagcgccatgacctctcccccagattcggtagctggtaagtagcttaccgctaagctacttatcgtcaagcaactttcttgcgaacgatcttcgggaagccggatactgcgcacatgagtgacgacaaggacgcggtggacgcgatcacggaccagtggttcgccgtgcgccccgatctggagacggctcccatggccgtcttcgggcgcatctaccggatcgccaggaccatgggcgacgcgatggaccagtgctacgcgcgcttcggtatctcgcgcggcgaattcgacgtcgtggccaccctgcgccggtcgggggagccgtacacgctctcgccccggcagctgtcggccaccctcatgctcaccacgggcggcatgaccgggcgtctggacaagctggagaaggccgggctgctctgccgcaagcccgatccgcacgatcggcgggggctccaggtgacgatcaccgagcgcggcctcgcgctcatcgacgaggccgtcggcgccggtctggaagtacagcgcgccgcgctcaccgggctgaccgacgacgaggtcgccgtgctcaccggcctgctccgccggctcctggccggcgtctgaggacacgccaaggcgccgggggtcgtcgcacggccgaatcgaatcggcggtgcggacccccggcgcccgggaaggtctgctgctcccgaccccgcggggtcgggacggatcaggcctgcttctgcttcttgtccgacttgtcgaggaccatcacgagacccaggatgaccaggaagatcaccaggggcgtgaccacgtacaggccgacggtctcgccaatgctcaggcccgggcccgggtcgtcaccgtcgtcgcgggtgagcgcgagagcgggagacgtcatcagcagcatcatcagcgcggttccggccgtgacggcgccggcgcgcagagcgttcttcttgtccacggtgcaaacgtagcgaacacctaaacggggcgcgcgcccgggggtgccgtacggggtcgcgcaccctcccccaccgcgctcagcagggcgttcgcccggggcgaggacaccagctcctccagggtcaacggccgccccgcggcatcggcgaccggcagccgccaattggggtactggtcccaggtgcccggcaggttctgcggccgccggtcccccaccgcgtccggcagccatacgccgaccagccgcgcgggggtgcgcagcaggaaggtgtacagggcccgtacggcggcctcctcgcccttggtgtccagacccagcccgtccagcagctccagccactcggcggtgtcggcggcgtcctcggcacgctccagctcggccggacgggtcagcaggcccagccggtcgcgcagttccacatggcccccggcgagtttggcggccgtgggcggcaggtcgtgcgtggtgacggtggccaggcagtcggcccgccaggactgggacggcagcgggtccccgctgccgtcccagtcccgctcgaaccagagcaccgaggtaccgagcaccccgcgccgggccagctcctgacggacccgcggctccactgtcccgaggtcctctccgatgacgagcgcgcccgcgcggtgggcctccaggaccaggatcgccagcatggcctcgccgtcgtagctgacgtacgcgccctccgcgggcggggtcccctccgggatccaccagagccggaacaggcccatcacgtggtcgatgcgcagggcgcccgcgtagcggaacaccccgcgcagcagggaccggaagggggcgtacccggtggcggccagcacgtccgggcgccacggcggcagtccccagtcctggccgcgcgcgttgaaggcgtccgggggcgcgccgaccgagatgtgcggggcgtagcagggtgatccgaagacgtcggaaccctgcgggtgcactccgacggcgaggtcgtggacgatgccgaccgtcatgccggcctcgcgggcggcccgctgggcggcggcgagctggccgtccgtcagccagaccagccagcggtggaaatcggcccgctcctccaggccctcctcccccgcgtgtccggcgcaccagacggcgtgcacgtccagcggagcgccctgttcggcgcagaaggcccggtaggcggcttcgcgttcgggcgtgcgcgggacggcgtacagcagctccagggcggcccgcttgagctcccagacggcgtcacggtcgatcagcgcgcccttctccaggacctggcggcgcagttccccgccgcgggcggcgagcgcgtcgagggcccggcggtcggggcagtcggcgtattcggggacgtcctcgatcctcaggtggaccgggtccgggaagcgccgcgaggacggccggtacggggaaggatcggtcggggccccgggcaccgccgcgtgcagcgggttgacctggatgaacccggcgccgtgcgtccggcccgcccagcgggcgagctccgcgaggtcgccgaggtcgcccatgccccaggagcgctcggagagcagggagtagagctggacgagcagtccgtgcgcccgctcgggcgcggccggggcccgctccggggccacgaccagggtggcctcggcgctgcgcccgtcgggtgcctcggcggtgagccggtggacgcccagcggcagtgcggggccccactcgagcacctctcctgtctcctccgccaccacgcgcacccgggtgcccgggggcagcccgacgggctccggagccacccgttccccccgccagagcaccaccgtgggcggcagcagccgcccggccgcctcccgggcggcggactcggcgaggacccggatgctcgccgcgtcgtcggtgaccgcccccagcagtccgaggaccgccttgacggtggtcgccggtaccgggacggtgacgtccggggcgggccggtagtcggtggcgacgccgtactgggcagcgagccgggccaggtcgtccatctgcgggcgctccttcgtgcgggtgggcatgagggcatgaggatgagtcagaagactggggcacaagggtggttcacgagggtgggacgccgccggggaacaccgcgtccatacccactcggaggcaccgcattcctgccatatccggggcagatcacccatccacattgacaccccagccgcacggatggtgggctcaggctcattcgtacgagtgggggacgtctcgggacaaggaggctctgtgcagctcaggggcaggaggcggaacaccgccgccgctgtggcggtgatcggcacgctgctcggcggagccgtgtcctccgcaccacccggggtcttcgcggcgcccaccacaccggacagacccgcgtccggaggcaattccggagccacccccgccgcggccgtggccgggccggtgctcgacccgggagccgacaccccccgcgcggtcaccgaggggcccgccgtgtggccccggccgcagtccatggccgccgacccggcgcgcgagctgcacctgggcaccgaggccgtactcgtcgcggcggccgacgccgatccgtacgccgtccgggtggtgcgggacgccctgcgcggagcgggcgtacggaccgtccaccagccggcccccggtgctccgctgcccgcacggggcaacgtcgtacggctccagggcgcggacgcggaggaagcgctgcgggcgctgggctcggccgcgccggcggacctgccggccgggggctaccggctggccgcgggccaccacgccggccgggacacgatcgcgctggtcggcataggcggggaagggctcttccacgcggcgcagacactgcggcaactcctggcggcgagcggcgggaagatgcccggagtagtcgtccgggactggccggccgccccggtgcgcgggatcaccgagggcttctacggccagccgtggacccaggaacagcgcctcgaccaactggacttcatgggccgcaccaagcagaaccggctgctcatagcgcccggcgacgacccgtaccgcacgacgggctggcgccaggactacccggcggagcagcaggcggaattccgcgcgctggccgaacgggcccgcgccaaccaggtcgtcctggcctgggcggtgactcccgggcagtcgatgtgcctgtcctcggaggccgaccgggcggcgctcgcccgcaagctggacgcgatgtgggacctcggcttccgcgccttccaggtgcagttccaggacgtcagctacaccgaatggggctgccgggccgaccgggaccggtacgggaagggcccggcggcggccgcgaaggcgcacgcggaggtcgcgggcggactggcggcgcacctggccgcccggtacccgggcgcgcccgcgctgtcgctgctgccgacggagtactaccaggagggcgccaccacctaccggacggccctggcgggcgcgctcgacccgcgggtggaggtcgcctggacgggcgtgggcgtggtgccgcgcacgatcacgggcaaggaactggccggggcgcgcaccgccctggggcacccgctgatcaccatggacaactatccggtgaacgactgggatccgggccggatcttcctcggcccgtacgcgggccgcgagccggcggtggcgggcggttcggcggcgctgctggccaacgcgatgccgcagggcaccctgtcgcggatcccgctcttcacggcggcggacttcgcgtggaatccgcgcggctaccggccgggcgagtcctgggcggcggcggtgcgggagctgacgggcgccgacccgcgcacgcgccaggcggtggcggcgctcgccgggaacaccgcgtcgtccgggctcaagcaggaggagtccgcctatctgaagccgctggtcgagcagttctggaaggcccgcgcggcgggtgatccggcggccggggccgagctgcgcaaggcgttcacggtcctgcgcgaggcacagaaccggctcccggccctggcgggcgaggcgggaccctggctggagcgcctggcggcgtacgggacggcgggcgagctggcggtggacgtcctgcaggcccaggcccgcggggacggggcggccgcctggcaggcctcccgggcgctgaccgaggcgcgcgcggcactggcgcggccgggctcggcccgggtggacaaggccgtcctggagcccttcctgacgaaggcggtggccgaggccgacgcctggaccggactcgcccgcaagaccggcacggtgacgaaggagacggaggcctggaccgtacggctggacgccccgcgtccggtgtcggcggtgacggtgatgaccgacccgctcccggccggggcgcggggcgccgtggtggaggcgcacgtaccgggcgagggctggcgcaaggtcgccggcgccgcggcatcgggctggacccaggtggagacgccggggctgaacgcggacgcggtacggctgtcctgggccggggccgagtccgcgcccacggtgcaccaggtggtgccgtggttcggggacggcccgcgggcccgcttcgagctgacggacggggccgcgaccgacgccgagatcggcggcgccgtgcggcaggtctcggcgcagctgtccgcgctggggccgggcgaggtccgcgggccgctgtcggtgcggccgccggcgggcatcgaggtccgccttccgcaggccgcggtggctccgcggggcggccaggtgacgatcccgctggaggtcagcgtcgccgcgggcaccccgcccggcagctaccaggtgcccgtgaccttcgacggggagtcacgcaccctgacggtgcgtgcggtgccgcgcaccggcggccccgatctgctgcgcaccgcgcgggcgagctcctcggcgaacgagacctcgggcttcccggcctcggcggccgtggacggctcggcggccacccgctggtcgtccccggcggtggacggcgcgtggtggaaggcggagctgcccgccccggctcgggtgggccgcgtggagctgcactggcaggacgcgtacccgtcggcctaccgggtggagacctccgcggacggggtgacctggcgcccggcggccaccgtgaccggctcccggggcggtcgcgagtccctccgcatggacgccccgggcacccgcttcctccgtgtcacgtgcgacacacgcgcgacgcggttcggctgctccctctggtcggcggaggcctacgcggtcacgccgtgacccccggccccgccggcgtgtgaggcgccgggcccggggcggagccccgtcaagccgggccgcaggtccccgtcgggcgcaccccgcagggaatcggcggcccggcggcggagctacccggccgcgaccccgatgccgatgcggtccagcgcgtcctcggccccgtacggctggagatacggcatccaccgcggatcccggtgccccgtgccgatgatccgccacgccagcccggacggcggcgccggctggtgacgcaggcgccagccgaggtcgaccaggtgccggtcggctttgacgtggttgcagcggcggcatgcggcgacgacgttgtcccaggcgtgctggccgccccggctgcgcggaatgacgtggtcgacgctggtggcgacggcgccgcagtacatgcagcgaccgccgtcccgcgcgaacagtgcgcgccgggtgagcggaacgggcccccggtaggggacccgcacgaagcgcttgagccgtaccacgctgggcgcggggacgaccctggtcgcgctgtgcagataggcgccggattcctccagggagaccgctttgttctccaggacgaggatgagcgcgcggcggagcggtacgacgccgaggggctcgtacgacgcgttgaggaccaggacgtgcggcacggactgcctccttgtacgccggcggcgcgtggctcgcgccgggacgatctgctctccagtctctccttagggctggtcgaaacgccaccactcgcccgtaacgggtccgaggtgttttcaaccacagtcagtcatccccaggtgagtctggtctctccctcgaacacggcaccaaggtgaagggattgccccgttagtgtggttggtctgccccgcatgtccccggatccgtccggggcccccggttccgggggcagaccgctacacctggaggttcccgtcgtgccctggcccgccgctctgctgccgctggcagccgacgttccggacgcgcccgcatcggtcaaggaggcgcaggcaagcgtcaccgaggccgccagcttcatcgagcagaactgggccacctggctgagcatcggcctgcggatcctgctgatcgtcgtgatagcggcggtgatccgctcggcggtccgcaaggcgctgacgaagctcataacccggatgaacaccagcgccgaggcggtggagggcaccgcgctgggcggcctgctggtcaatgccgagcggcggcgccagcgttcggaggcgatcggctcggtgctccggtcggtggcctcgttcctgatcctcggtacggccgcgctcatggtgctggccgcgctgaagatcgatctggccccactgctggccagtgccggtgtggccggtgtggccatcggtttcggcgcccggaacctggtgacggacttcctgtccggcgtcttcatgatcatggaggaccagtacggcgtcggcgacaagatcgacgcgggtgtggcctcgggcgaggtcatcgaggtcgggctgcgcgtgaccaagctccgcggggacaacggcgagatctggtacgtgcgcaacggcgagatcaagcggatcggcaacctcagccagggctgggcgaccgcgggcgtggacgtccaggtcaagccctcggagaacctgtcccggatccgcgaggtggtcaaggaggtcgccgacgccatggccaaggagtccccgtgggacgagcgcctgtggggtccggtggaggtcctgggcctggacgaggtgctgctcgcctcgatgacggtgaaggtgtccgccaagaccatgcccggccagcagttctcggtggagcgggagctgcgctggcggatcaaggaggccttcgacgccgcgggcatccggatcatcggcggagtgccggcccccgacgaggacgaggaggccccggcggatccgtcggcctcggtcgccgcgccgtccgcgctggcgaacccggcttccccgcagtcgctggccaccgccccgatcccgccgccggccggcccgcggatcacgaagtaaccgagcagacgcgctgccccgcaggtcattcgtgaaatgacacagcctgcggggcagcggcattgacacacttcaacaggtgataggaaacttacctaacagatcacctcggtgagggagagccgctcgatgcccgccgccacgcccggaacgcccagcctgttgcgcgccatgaacgaccgggccgcactcgaactcctgctgacgcacggcccgctgtcccggacccgcatcgggcacctgaccgggctgtccaagcccaccgcctcccagttgctcgcccgcctcgaagcggtcgggctcgtcgtggccaccggcacggacggcggacggcccggccccagcgcccagctctacgcgatcaacccgcgcgccgcctacgtcggcggcctcgacgtcacccccgaccgggtgctggcggccgtcgccgacctcaccggcacggtggtcgccacccacgaggtcccctacaccgagggcgcgaacgccgtcgaccaggtgaccgaggccctcggcgaagccgtcaaggccgccggactgcaccgcaccgacctgcgccgggtggtcatcggcaccccgggcgccttcgacccgcagaccggccggctgcgctacgcgagccacctccccggctggcactcccccaccctcctggaggagctggcggcggccctgccgatgcccgtcgagtacgagaacgacgtcaacctcgccgccgtcgccgaacaacggctcggcgcggcgcgcggccacgaggacttcgtcctgctgtggaacgaggaggggctcggcgccgcactcgtactgggcggccgcctgcaccgaggctggaccggcggcgccggcgaggtgggcttcctgcccgtgccgggccggcccctggtccggcaggtcacccgggccaactccggcgggtaccaggagctggccggcgtggaggggctgccccggctcgccgcggaactgggcatggaccttccggacacccccgagacccccgacacccccgacgcgcccggtgcccccggatccccgcacggcccggaggtcgccaccgccgtcgccctgctcgcgcgggccgccgccgcgcccgagggggcgcacctgagcttcctccggtcgtacgccaccgcgctggccaccggtctcgcctcggtcgtcgccgtgctggacccggagatcgtggtcctgtccggggcggcgatcgacgcgggcggcgagccgctgcgcgcgctgctggaggccgagctcgccgaactggccccttcccggccccggctggtccccggcgaggtacgggagcggccggtcctgcacggcgcgctggagagcgcgctggccgccacccgggacgaagtgttcgacacctcgggctgaaccgcccgcccgccccaccgccacccccaccggcaccccccacggaagttcctcccgcagagagagcgagccccgccatgcccagaaccggacgcctgaccaccgcgaccgccgtcctcgcggcgatatccgccctcgccacggcctgtacgggccagggcgcggacaccgcctccgacgatccgaaggcggacgtcaccctcaacttctggcacggctggtccgcgccgagcgaggccaaggccatcgaggagaacatcgcccggttcgagaaggcgcacccgaacatcaaggtccaggtcaccggcaacatgaccgacgacaagatcaaccaggcgctgcgggcgggcggggacaaggcccccgacgtggtctcctccttcaccaccgacagcgtgggcaagttctgcaactcccgtgccttcgccgacctgaaccccttcctcgcgaagtccggggtggacaagacgaaggtcttccccaagaccctgctcgcgtacacggagttcgacggcaaccagtgcacgctgccgctgctgcacgacgcgtacggcctcgtctacaacaagaccgccttcgcggccgccggcatcaccgaacccccgaagacctggagccagttcaccgaggtcgcgcagaagctcaccaaggcggatgcgtcgggccactcgtacgagcaggtcggcctgatgcccaccttccacggctacgagaccaagccgacgcggctcgcggcgcagtggggcgccacgtacttcggcgccgacggcaggtccaacctggccggggacccggccttcgccaagatgctgagcgcgcagaaggacctggtggacaagctcggcggctacgagaagctggagcggttccgcaacaccttcggtgacgagtggagcgccgaacaccccttccacaccggccaggtggccatgcagatcgacggcgagtggcgtgcctccatggccaaggaggccggggtccccttcgagatcggcaccgccccgctgcccgtccccgacgagcaggccgccgactacggcaagggctacctcgccggcacgatcatgggcatcgccgcgggcggcaagaagcagaacgccgcctgggaactggtcaagtacatgaccaccgacaccgaagcggtggtggccttcgccaacgccatccacaacatcccgtccacgttcgccgcgctggagtccccggacctgcaggtgaccccggagttcaagaccttcctcgacatcgcccggcacccgaagtccagcaccaccccggccaaggccgacggcggcacctaccagctgaccttcgaggacttcgcgtacggggtcgagaaaggcgatgtcaccgacatcccggccggtctcgccaggaccgaccggcagatcgacacggacatcgcgaaggcgaagtagcccgatgaccggcgcccaccccctgcggtcgaagcggcggcgctccgccctgcggaccgcggccttcctctccccctggctgatcggcttcgcggtcttcttcgtctacccgctgctgtccacgctgtacttctccttcacccgctacgacggcttccggcagccggccttcaacggcctggacaactggagctacgtcttcacggactatccgctcttctggccagcgatgcgcaacacgctgtggctggtcctggtgatggtgacctgccgggtcgccttcggactcggcatcggcctgctcatcacgaagatcaagacggggaccggaatcttccggaccctgttctacctgccgtacctggccccgccggtcgccgcgaccctggccttcgtcttcctgctcaaccccggcaccggacccgtcaacaccctgctggacgcggtggggctgcccacgcccggctggttcaccgacgccgactggtccaagccggccctgaccgcgctcgccctgtggggggtgggcgacctgatggtcatcttcatggccgcactgctcgacgtacccaaggagcagtacgaggccgcggagctggacggggccggcgcctgggcgcggttccggcacatcaccctgcccaacatctccccgatcatcatgttcgccgtggtcaccggcgtcatccaggccatgcagtactacgcccagccgctggtggcggggaaggtcgcggccggggtgatcggcggctccggccagcagttcgagccgggctatcccgacaagtccaccctgacgctgccccagctcgtctacaacctcggcttccagcgcttcgactacggcaccgcgtgcgtcgtcgcgctcgtcctgttcgccctctccatggccttcaccgcgctcctgatgcggcgccgtggcggtctgatcggagctggtgaatgagcggcgcgcgcaccggccggaaatcctcccgcgcggtcctgcactgggtcggggtgcactcgctcggcgtggccgccgccctcttcttcgtcctccccttcgtcttcctcctgctcacctccctgatgggcgaccggcaggcgctcacccgcgacctgtggcccgacacctgggaatggggcaactacgcgaaggtgtggcacaccccgggcttcctgacctggtggcgcaacacgctcctgtacgccggactcggcactctgttgaccgtggtctcctccgtgcccgtcgcgtacgcgctcgccaagttccgcttccgcgggcggcggctcgcactgctcctcgtgatcgccatgatgatgctgccgccgcaggtggtggtcatcccgatgtacctcttctgggcgaagcagctcgacctgtcgggcaccctgtggccgctgatcgtcccgatggccttcggtgacgccttctccatcttcctgctccgccagttcctgctgaccatccccgacgagtacctggacgcggcccgcgtcgacggctgcggcgaagtgcgcaccctgctgcgcgtggtgctgccgatggccaagcccgggatcgccgccgtcgcgctcttccagttcttctgcgcctggaacgactacttcggcccgcagatctacgcctccgacaatcccgccgcctggaccctcagttacggactggagtccttcaagggggcgcaccacaccaactggaacctgaccatggccgcgaccgtgctggtcatggccccggtgatcgtcctcttcttcttcgcccagaaggcgttcgtcgagggagtcaccctgaccggcgtgaaaggctgacgacgatgaaactcgcagtggtgggcggcggttccacctacacccccgaactgatcgacgggttcgcacggctgcgcgacaccctgcccgtcggcgagctggtactgatcgacccggccgccgaacggctggagctgatcggcggcctggcccggcggatcttcgcccggcagggacatccgggccgggtgaccaccaccgccgacctcgacgcgggagtcgaaggcgccgacgcggtcctgttccagctgcgcgtcggcggccaggccgcccggctgcaggacgagacctggccgctggagtgcggctgcgtcggccaggagaccacgggcgcgggcgggctcgccaaggcgctgcgtacggtcccggtggtcctcgacatcgccgagcgggtccggcgggccgccccggacgcgtggatcatcgacttcaccaacccggtcggcatcgtcacccgggccctgctccgggccgggcacaaggccgtggggctgtgcaacgtggccatcggcctccagcggaagttcgcggccctgctggacctggcgccggccgggatccacctggaccacgtgggcctcaaccacctcacctgggagctggccgtgcgccggggcggcccggacggcgaggacctcctgccgggtctgctcgccgcgcacggcgacgccgtcgccggggacctgcggctgccgcgggcggtgctggaccggctcggcgtcgtgccctcgtactacctgcgctacttctacgcccacgacgaggtcgtacgggagctgggcaccaagccctcgcgggccgccgaggtcgccgcgatggagcgggaactgctcgccctgtacggcgatcccgcgctcgacgagaagccggcgctgctggcgaagcggggcggtgccttctactccgaggcggccgtggacctggccgcctccctgctgggcgacggcggcccggccgtgcaggtggtcaacacgtacaacaacggcacgctgcccttcctgccggacgacgcggtgatcgaggtgcaggcgcgcgtcgacggatccggcgccgtccccctggcggtgccccggctggacccgctgttctccgggctgatctcgcacgtgagcgcgtacgaggacctcgccctggacgcggcgctgcgcggcgggcgcgagcgggtcttcaaggcactgctcgcacacccgctggtcggccagtacgacctggccgagggactgaccgaccggctcctcgcgcacaacaaggagcacctgccatgggcgtgaccccctgttccgtcctcgcgatcgacgcgggcaacagcaagacggacgtggcgctcctcggtccggacggctcggtcctggcctccgggcaggccggggggttccagccgtcccgggcgggggtggccgcggccgtcgacgtgatcgccgaggcgatggcctccgtcgggctggaccaccgggacgggcgcggccgcggtccctgggccgagcacgtgtcggcctgcctggccaacgcggacttcccggtcgaggaacggaagctggcgcgcgagatcgagcgccgcaactgggggcgcgagacggaggtgcacaacgacaccttcgccctgctgcgcgccggcctgcccgtgggcgcagagccctgcggcgtcgccgtggtgtgcggagccgggatcaactgcgtcgggatgaccccggacgggcggaccgcgcgcttccccgcgatcgggcggatctccggcgactggggcggcgggggcggactggccgacgaggcgatgtggttcgcggcccgggccgaggacgggcggggcgggccgaccgaactggcccgggcgcttcccgcgcacctgggcctcgactcgatggcctcgctgatcgaggcgatgcacctgggccggatcccggccgggcggcggctcgacctggccccggtgctgttcgcggtggcggccgccggggacccggtggcgctgtcgctggtgcaccggcaggcggacgaggtggtggccatggcatcggtggcgctgggtcgcctgggtctgctggagcaggaggtaccggtggtgctgggcggcagtgtgctggcggccggacacccgcagctcaacgaccggatcgcggcgggcctcgccgaacgggccccgcgcgcccggatctccgtgatcacggcgccgccggtgctgggtgccgggctgctgggcctggacgcgctcggctccccgcccggggcatatgaaaaactccgtgcccatttcgggtgaacccgccccggaagtcctcaggtctggaaccgtggcgcccgtagggacgtattgacggtgaaggggcgacgaagggggccctcagggacggatcgccctggatccagcaccgggtgctgtggtcgaccggcactacggccatactgctgcgcagggggtacctcccagcgtcggctggaggacgacaggaccgagggggaggtcacggtggcgatcacatcacgcgcgcccgcacccgggggcgatgtcgccgtgccgtccgccgggccgtcggcgccggcgcccgacgggccgcccgggcgcaccgcctgggccgagggcgtggagcggctgcgcgaagcggccaccaccgagccgggccggctgcggatcatcggcgcggtactggccgccctcatcatgctgttcggcgcggtgagcgtgtgggagatctcggaccgggccgcggccgcggacgacgtggtgggccgcagccagccgctgagcgcggacgcggcgagcatctaccgttccctggcggacgccgacacgacctcctccagcgggttcctcctgggggcccaggaaccgcgcgaggtccgacagcggtacgagaaggacatcgccaacgcctccaagctgctggtgagcgcggccgccaacaccggcggcaacgaggactcccgccggcagatcaccgtgctgagcgagcagctcccgcgctacaccggtctgatcgagcaggcccgggccaccaaccggcagggcctgccgctgggcggcgcctacctccgttacgccaacgagcagatgaccacccagctgctgcccgccgcgcagcggctgtacgagtcggagaccaagcggctctacacggacgacgacgacgcccggtcctggccgctggcctcgatcggcctgggactgctcgccgtcgccgccctggtctgggcgcagcggcgcaactaccggcacacgaaccgggtgctcaaccacgggctggtggccgcgacggccgcgtcggtggtggtcctgctgtggctggccgtggggcacacagtggcgcgggcctcgctgagcgaggcccggaccgacgggcaggagtcgatgaaggtgctcaacgacgcgcggatcgcctccctgcaggcgcgggccggtgagaacctgaccctgatcgcgcggggcgccgtactcgccgaggacaagaagtccgacaagtacgacgtggacttcacgaacaacatgaagcagctggacgccgggctggcgaccgcgctgcggctcgccgacgacgacgccggccgggaccccgtcggccgggccgcggacggtgtgaagcagtggaagcagcggcacgcggcggcccgggaggcggacctgaagggcgactacgaggccgcgctgccccaggtcgtcggggacgagcagcaccaggagagcagcggcgccgccttcgacacggtggacgcctccctggaacaggccgtcgcccacgagcagcaggagttcacccggtccgcccaggacgggctcggcgcgctgggaggtctggtgacgggcgccgcggcgctggtggtcctcggcgcggtggcgaccctgctcggcatcgggcgcaggctttcggagtacaggtgagcgcgatgcggatacgagcgaggcgggccgccgaaggtcacgagaaccccgagggccgggagcgccggacgggacgggccgcgacggcgggcacggcgtccggcgtccgccgcgccgcgcgccggctgcgcggctggggcggggtgagcgcgatggccgtcgcctgcgcgacgaccgccgccgccgtcctgctgccgctggcccacgcgacgcccgacaccgggcgtcccccggtgcgccggcccgcttcgatggcggcggccccggccgcgccctgggccctcaccgacacctgccaggatcccgaggccagcctgcgcccctccgacgtggacggggcgaccatcgcgcggatcaaggccgcgggcaagctcgtcgcgggcgtggaccagaacagcttccgctggggctaccgcaaccagaccgccgacggcagccacctcgacggcttcgacatcgacctggtcaaggccatcgccaaggacatcctgggcgacgagaacgcggtcatctaccgggccatccccaccagccagcgcatccccgcgctccaggaggggcgcgtcgacatcgtcgtgcggaccatgaccatcaactgcaagcggctggaggacgtcgccttctcgacggcctacttcgaggccggacagcaggtgctggtgcccaagagctcgccgatcaccgggtacgacacctcgctgaagggccggcggatctgcatcgcggccggctccacggccgaggcggccctgaaggcccagtcgtacggctcggagcccgtcaccgtcgccaaccagctcgactgcctcgtccggctccagctgggcgaggtcgacggcatcatcacggacaacgccctcgcggccggccaggccgcccaggacccctcggtgcggctggtgggctcgcccttcacccgcgagttctacggggtggcgatgaacaaggacgcctccgacctggtccgccgggtcaacaaggtgctggagaactaccgcgcgggcggcggtgagagcccgtggatgaaggcgtacctcaagcacctgcagcccgtgctgcccggcgtgaccgcgccccccgcgcccaagtaccgggacggctgaggccggtgacggtttcggacacgggaccgggtgcggagcggggcacgaaggcggacacggaggcggcggcgcaagaggaggcacagtcggtggaggcggggtcggcagtgatggaccgggacggcgtcgaccgcgccctgtcccggctgggcgcggagcacgaggccgtcgagacctcactgctcgccctccaggaccacgccgggcgccggctgctggagggcgccgcgctgaccgggaccaccaaggagcggtggacggccgccgatgcggacatcacccggctgtggacgtacttcgacgcctacagcggggcgctgaccgccgcccgggaggtgagggagcggcgccgctggccgaaccgcgaggacctcgtcgagctgaccgagcggctgcgcggaccgggggtgctgatcgccggggccgcggccgagggcgtcgcgctggccgagcggctctcgctggccgagctgctgacccggatgaacgccctgtacgcgcgctcgctggacgtggtggtcgccgccgacgccgtgtggtcggcgctgcccgcacggatcgacctgctctccgccgagctgcaccgcacgcggtcgctggcccactcggtgggcgtgcggccgggcgagcacccctccggcgacgacctggaggacatcaccgccgaactgacggagctgcgcgtccaggtgatcgcggacccactggccttctggctcccggcgacgggcagctcggctcccggcggcggccgtccggacaccgggcgctacgaccgggccgcgctcgcgctggaggacgtacgccgcgaggtcgaggcggtgctggacgtacggcaggacgccgagcagcggctgatcgccctgcgggacgtgctctcgcgggccgaccggaccctggcggaggcgcggaccgcgcgcggcgaggtgctggcgaagatcgccgcgtccgaggtgcccgcggtgagcggcccgcccacggtgctccaggagcagctcgcggcggcggccgaacaccggcgccaggcccgctggcaccggctctcgcccctgctggaatcgctggaggagcgcgccgaggaggaactgcggcgggcccgtgaatcgttgaccgccgtgacggcgccgctggcggtacgggccgagctgcgcgggcggctcgacgcctacaaggcgaaggtggcccgccacggattggcggaggacccgttgctgatcgagcggtacgacaccgcccggcggatgctgtggagcgcgccctgcgacctgcgggccgccgagcaggccgtcctgcgctaccagcacgcgacggcggagtcgctgctggcgccccagggccggcccgggcaaccgcgacacgaggaacagcggcccggcgggccgggggaggaggacgcatgagcctgatcggaaccgcgtgcgttcgccccggctgcccgggggcgtacgaggacatgggcggcggcgaggtctactgcgacacctgcgggctggcgccgatcggctccgtcgcggcgggcgcggacgagctggtgtcgccgccgaccggcatgacgagcgcggcccgcggctccctgggctccggcgggtcccgcgggtcgatgggctcgcagggctcccacggctcggcgcggtcctcggcctcggcccggtcctcgcggtcctcctcctcgcgccgctcggtgtccgggcggctctcgcgctcggtgtcggggacgacatccacgcgttcggtgtcggtgcggagttcgggctcggcggcctcgggccgcagccggctgggcgccggcctggtcaacgtgccggaggtgccgcgtccgaatccctcgaccgccgtcctggagaacccggaggtgccggagcgcaagcggttctgctcgcgctcggactgcggggctccggtgggccgctcccggggcgaccggccgggccggacggaagggttctgcaccaagtgcgggcacccgtactccttcgtgcccaagctgcgctcgggtgacgtggtgcgcggccagtacgaggtggcgggctgcctggcgcacggcggtctcggctgggtgtacctggcggtggaccgggccgtcgcggaccggtgggtggtcctcaagggcctgctggacaccggggaccaggacgcgatggaggccgcgatctccgagcggcgcttcctcgcggagatcgagcactccaacatcgtgcggatctacaacttcgtggagcacctggaccagcggaccggttcgctggacgggtacatcgtcatggagtacgtcggcggcaagtcgctgaaggagatcgcgaacgagcggcgccggccggacgggcggcgcgacccgctgccggtggagcaggcgtgcgcctacggcatcgaggcgctggaggcgctcggccatctgcacagccggaacctcctgtactgcgacttcaaggtcgacaacgcgatccagcagcaggaccagctgaagctgatcgacatgggcgcggtccggcggatggacgacgccgagtcggccatctacggcacggtgggctaccaggcccccgaggtcgcggagctgggcccctcggtcgcctccgacctctacacggtggcgcgcaccctggccgtgctgaccttcgacttccagggctacaccaacgtgttcgtggattcgctgccggatccggagcacatcgaggtgttccggcggtacgagtccttctaccggctgctggtccgggccaccgacccggacccggggcggcggttcgcgtccgcgcaggagatggcggaccagctgacgggcgtgctgcgggaggtggtcgccctgcagacgggccggccgcggccgcagctgtcgaccctcttcggcccggagctgcgggttccggacacccagctgttcgccgacgcggccgacgccgtcgtctcccggctgggctgccggccgatcgcctcccggccgtccgtctcccggcggggcggcgggctgttcggagcccgcggccgcggcggggtaccggccggggtccccgcgcccggtggcgcgcacgcgcccggggcgtcgggcggcccggcgccgtccggcccggccgctccggctccgggaccggcgggcgcatccggcccctgggcgcaccagcacgtcggcggcacgccgccgggcggaacgcccgcccccggggcgcccggtggcgcggcgacggcccggcccgggaatccggccgggggcgcgccgctgcccgcgctcgggagcacgagcacgcacatgacgggggcgccggtgccgggaccgcggcaggcgcccacggccccggcgacggcgccggctccggtcccgggtgcggggccggtaccggcccccgtgtccccgccacccgccgcgggagcgaccacgctggacgcgcgcgacaccgcgctggccctgcccgtaccgctggtggaccccgccgacccgaacgccggtttcctgaccggtctgctggcctccgcgccgggcgacctgctgggcgctctgagcgcggcgcccgccgagtcggccgaactgcggctgcgggagctgcgggcccgcctggagctgggcgaactgcccgaggccggacgcgccctggcggagctggaggcccggcatccggacgactggcgggtggtgtgggcccgtggcatcgcctcgctggccaccggtgacgacgagatagcggccctgtccttcgacgcgatctacgacgccttcccgggcgagcccgcgccgaagctggccctcgggctgtgcgcggaggtgctgggccagctggacaacgccgccgagtactaccgcctcgtgtggatcaccgaccccggcttcgtgagcgcggccttcggtctggcccgcgtccaactggccgccggggaccgggacggagccgtgcgcacgctggaatccgtaccggagtcgtcgatccactacaccgccgcgcgggtggcggccgtacgcgcacgtctgcgcgaccggtccccgcaggagccgctgctggccgacctggcggccgcagcggaccaggtggaggccctgcggcggttcggactggacccggagcggcaggagcggctcgcgacggaggttctgggcgcggccctggactgggtactgtcgggtagccggggttccgaccccggccggacctcgctgctcggcagtcaactggacgagcggggcctgcgcttcggactggagcgctcgtaccgcgtcctcgcacggctggcgcggcgtggcgaggagaggatcgaactggtggagcgggcaaaccgtttccgtccccggacgtgggtgtgagtgatgtcgatgcatcggctgtcgggctgccccagctgcgcggaacccctggaggagggtgaccgtttctgcggcgtctgcggctacgccgtgagcgctcctcccccggccgccgtggaccacccgaccatccccatcccaccggcgccggcgggcggttacgcgagcccggcccccggtgtcccgcacgcggccgccgagcccgccccgggctggggcagcgccgcctcggccgcgccgacgctggtggacgacccggccgcctgggccgccggcccggcggagacggagcccgaaccggagccgcggcagggcccggccggagccacgtacgccgcctccggccacggcaacccgtacggcaccggcaccccgccggagggcaccccgtggggagcggcggagcacccgtacggcgccgccgcggacgccccgcgggcccggtacgacctgcccggcgacgccaccgcgcccggcgggagcgggcaccccgccggcgagaacccgtacggccccgagtccgaccgggaaccggcgtacggcgccccgcagccccagcccgcggccccggagggcgggaagacctgcgtcgcctgccgcgccgggcgcgtcgacaccgacgggtactgcgagcactgcgggcacgcgcagccccgcgagcgcgaccacatcgaggaggagctcgggagcgtcgccgccgtcaccgaccggggcctgcgccaccaccgcaacgaggactcgttcgccgtgtccgccaccgccctgcccgacggctccgccgccaccgtggccatcgtctgcgacggcgtctcctccgccagccgccccgacgaggcgtcggccgccgcggccgtcgccgcgaacgagacgctgctcgaggcgctcccgcgcggcgcccacccccaggaggccatgcacgaggcgatcctggccgccgccgaagcggtgaacgccctggccccggagacccccggcgcgcagaacgcccccgcctgcaccctggtcggcgccgtcgtcggcggcggcctgctgaccatcggctgggtgggcgacagccgcgcctactggattcccgacgaccgcgccgccctgccgcgccgcctgaccgaggacgactcctgggccgcccagatggtcgccgccggtctgatgggcgaggccgaggcctacgcggacgtccgcgcgcacgccatcaccggctggctgggggcggacgcatacgacctcgaaccgcacaccgcgaccttcaaacccgaccaccccggggtggtggtggtctgcaccgacggactgtggaactacgcggaatccgcgcgggagatggcccaggtggtacccgccgacgccgcgacccgccccctgcacagcgcccaggtactggtggggtacgcactcgacggcggcggccacgacaacgtcaccgtggccgtcgtgccgttcgccacgcaccccgagcaggaaccgggaccggatgcggagccgggcccggcggcacgaccggaataggaagtggaagcgcgcccgcaggtctgacccgcctgcccgagccccctaggagtccaatcgatggcgaatttcgccaagccgagtgccccgcgcttcagcgtggaggtgtaccagaacgagttcctccccgagggcggacgggacgtccacgccatcgtcacggtcaccgccaccggcggtgccgccgccacccgcgcgccggtcgccgacggcacggcggccgtggtgctgatggtcgactgctcgggatccatggagtacccgccggagaagatgcgcggtgcccgtgaggccacggcggccgccgtcgacaccctgcgcgacggcaccgccttcgccgtgatcgccggtacgcacgtggccaaggaggtctaccccggccaggggcgcctcgcggtcgcggacgcgaccacccgcgcccaggccaaggaggccctgcgcgggctgagctccggcggcggcaccgcgatcggcacctggctgcgcctcgccgacggcctgctgcgcggctcgaccgccgccatccggcacggcgtcctgctcaccgacggccgcaacgagcacgaggagccggccgtgctccgcgccaccctcgacgcctgcgcgggccgcttcacctgcgacgcgcgcggggtgggcaccgactgggacgtcaaggaggtcaccgggatcgcgaacgcgctgctcggctccgccgacatcgtggccgacccggcccacctcgccgaggacttcacgcgcatgatggagaacgtcatgggcaaggaggtcgcggacgtcgcgctgcgcctgtggaccccggtcggcgtggagatccagtacgtcaagcaggtggcccccgtcctccaggacctcaccgaccgccgcaccgaggcgggtccccgggccggcgactacccgaccgggtcgtggggcgacgagtcccgcgagtaccacgtgtgcgtccgcgtcccgacggccaccgtgggccaggagatgctcgccgcccgcgccacgctggtcctgcccgttccggcgggcgggccggacgggaaaccggccgtcctggcccagggcctggtgcgggccgtgtggacggacgatctggcggcgtccaccgccatcaacgcgcaggtcgcccactacaccggacaggcggagctggcggaggctatccagcagggcctggaagcccgcaaaatgggcgatgtggggggtgccacggccaagctggggcgtgcggtacaactggcgagttcctcaggaaacgccgacacggcacgactcctgtcgaaggtggtggatgtggtggacgcggtggcgggtactgtgcggctgaaagcgaaggtcgccgatgccgacgagatgactcttgacacgcgttcgacgcagaccgtccgagtgaagaagacctgagacctgacgtgatgacgcagggagaagaagggggaagcgccgccatgccgacctgcccgaacgggcaccagtccgcgtccgacgactggtgcgaggtctgcggccaccgcatggctgcctcggagggaccgcccccggtgccctcctacggctacggcttccccccgaccgccggtgaaccgaccgcccaggccgagctctgcccgcagtgccggaccccgcgcgaggccatggccccgttctgcgaggaatgccgctacaacttcctcacccgtaccccgacttcgtacgcgcctgcggcccaggacccgggaccccaggcgacgggcgtcggtgccggcgggggtgccggcggtcgcggtacgcctccgccgcccgtgcccgctcccgggagctactcccaggaccacttcgagtaccagggctcgcggccgtcccgggtcaaccggccggccgagccgctgcagcgcgaggacgactggctgctgccgccgccggcgcacgagtcgccgctggagtaccagccggcgccgcagccccagtaccagcagcagcccccgccgcagcagcagcgggagtaccagcaggagtaccagcagcaggggccgccgccgcccccgcagccccagtaccagcagcagcctccgccccagcaccagcccttcccgccccagggcggtggcgcctggagcgcgacgatcgcccccgaccgctcgtacttcatggcgatgatgcagcgcagcggccccgaggccgccgggctcaacctgcccgcctactccccggagcagcaccttccgctgtctggcggccagatcaccatcggccgccgccgcgcctccacgggcgagtcccccgacatcgacctgtcggtgcccccggaggacccgggcgtctcccaccagcacgcggtgctcgtccagcagcccgacctcagctgggcggtggtggaccagaactccaccaacggcaccaccatcaacggcggcgaggagccgatccagccctacgtaccggtccccctcgtcgacggcgaccgggtccacgtgggcgcctggacgacgatcacgatccgccgcggctgattcaccccttccccaggggccacacgtagggcccctggggatcgtcgagccacgaccactggccctcggcgctcaccgagaccccgaagcgttcccgggccgggcggccctcgcgacgccacaggtccagggcctcgcgggggtgcaggacgcccgcggtcagcacgagcatgaactggaagcgctcgttctccaccagctcgtacgggagcccgtactccgtggcggccgggtcgggcggcggggcggccgtggccccgcgcagcgggacgaagtacgccgaggtgtggaggaagttgccctcggcgaaaccggcgtcccggacggtcagtgcgatcagcccggtggacagcggccccaggatccgcgcccccggccggcactggccgagccaggtgtacgggatcagcggcagcgtgcaggtcaccatgatccggtcgaacggggcccgggcggggcagccgcgcgccccgtccccggtgaccaccgccgggtggtagccgagttcggccaggtgcgcccgggcggactcggtgatctcctcgtccaggtccacggtggtgacgtgctcctcgccgagccggtggcagagcagggccgcgttgtagccggtgcccgcgccgatctccaggacgtcgtcgccgtcgcgcacgtccagggcgtccagcatcttcgccatcagggagggctggctgctggaggagacctgctgcccgtcgcgcatccgggtcgccagcggggtgtcgacgtagaccccgcgcagccagcgggcccggcgttcggggtcggggtcctgcgcccagagccgctcgtgaccggcgccgcgaccggtccagaagtacgggacgaacacgtgccggggcacggccgcgaaggccgcccgccagcgtgggtcctccagcaccccggcggcggtcagctcccgcacctgggcggcgtgcgcggtctcccgcaggtcccgtgtctcggtgtgcgcggtgtgtccggccatgcctccactgtcctgcgccgggccgccgggtgcgagcgcgagggccgcgggagcggcccggaggctttcgcgggccctcgggggatggtcctaggacctccgtcctggacccgggcgtctgagacgatggtcgggtgaacgagattccgcggggcacgcttcaggagcagaccttctacgagcaggtggggggcgaggacaccttccgccgcctcgtgcggcgcttctacgagggggtcgcgcaggacccgctgctgcgcccgatgtacccggaggaggacctgggccccgccgaggagcggttcgcgctgttcctgatgcagtactggggcggtccgaccacctacagccagcaccgcggccacccgcgcctgcggatgcggcacgcgccgttccaggtggacgcggccgcccacgacgcgtggctgaggcacatgcgggtcgcgctggacgagctcgggctggcgcccgagcacgaggcgcagctgtggaagtacctgacgtacgccgccgcgtcgatgatcaacaccgcgggctagaaccgcagccggccccgcgggccggcgcggtacccgggggtcagaccggccggacctggagggcgcccaggccgccggtgacgccggggcggcgcatggccacggaaccgtacggggtgcgcagccgcagccaggtcccggcggcgagcagcgccacgggggcgggggagccgggctgaggtgcggaggcgggcacgaccgcccgtaccggacgcaggaagcccagggactgtgcggcgtgcacggcgcgcagcgggagctcggtgtcgcccagcgtgcgggaccagatctcgcggccgatgcggtcgcgctcggaccgggtccggtgctgcacgggcagggcctcgtcgcgggcccggaactcggcgacggcggcggccacggccgcgcccatcgcctcggggccgggcagccccggcacctgctgccagccgccgcggggcgggagcaccccggcccagggcggtccggtgaccggcccgggcacggcggccccggccgaggcctcgtccacggactccagcagctccccggcggacaccgtcaggtccagcggcgtcgcgacgggagcggcgagccgcaccgtgcggatggccaggatgtcgaaggacggcggccgtccgaagacggcgagcgcgccgccgcccgcctggaggcgtacggcggcggcgcggtcgtagtgcaccagccggccgaggaaggcggcgaggtccgccgcctccccggcgtcggcgaagcgcagctgctcgttcatgccgcgatggcctcggaacgcggctcgtcgaggtactcctccaggaagtgcctctcctcggccgtgatgcggcggggccgcccggcggcgaggttgtagggcacgaccacggtctccgcgcgcacgtagaccgtctcgggcctgtcctcggtcgcctcgtccttgacctcgtagcggatggtcagggacgcggcgcctatccgggtcacccaggactcgatgaggaccggctcgtggcggtgcacgaggggcagtttgtagtcgatctcgtgacgggccacgacggagccgcccgtgaaggactcactgccctcccccggcgcgaggcggaacatgaagtcgatccgcgcctcctccaggtagcggaggaagacgacgttgttgacgtgcccgaaggcatccatgtccgcccagcgcagggggcaccggtagtggtgtctggccatgactgcgacctcagcctcgcgtcagcttcttgtaggtggcgcggtgcggacgggtcgcatccgggccgagccgctcgatcttgttcttctcgtaggactcgaagttgccctcgaaccagaaccacttcgagtcaccctcgtaggcgaggatgtgcgtggcgacccggtccaggaaccagcggtcgtgggagacgaccacggccgcaccggggaactccagcagcgcgttctccagcgaacccagggtctcgacgtcgaggtcgttggtgggctcgtcgaggagcagcaggttgccgccctgcttgagggtgagcgcaaggttcaggcggttgcgctcaccaccggagagcacaccggccggcttctgctgatccgggcccttgaagccgaaggcgctgacgtacgcgcgggacggcatctcgacgttgccgacgttgatgtagtccagctcgtcggacacgaccgcccagagggtcttcttggggtcgatgttggcgcggccctggtcgacgtacgagatcttgacggtctcgccgaccttgatctcgccggagtccggcttctccaggccctggatcatcttgaagagcgtggtcttgccggcgccgttcgggccgatgatgccgacgatgccgttgcgcggcagcgtgaaggacaggtcgtcgatgaggaccttgtcaccgaacgccttggagaggttgttgacctcgaccacgatcgaacccagacgcgggcccggcgggatctggatctcctcgaagtccagcttgcgcatcttgtcggcctcggccgccatctcctcgtaacgggcgaggcgggccttggacttggcctggcggcccttggcgttggagcggacccactccagctcttccttgaggcgcttggcgcgcttctcgtccttcttgccctcgaccttgaggcgctcggccttcttctccaggtaggtggagtagttgccctcgtaggggtgcgcgcggccgcggtcgagttcgaggatccactcggcgacgttgtcgaggaagtagcggtcgtgggtgacggccacgacggcgcccttgtactgggccaggtgctgctccagccagttcacggactcggcgtcgaggtggttggtgggctcgtcgaggagcagcaggtcgggggcctccagcagcagcttgcagagggccacgcggcgcttctcaccaccggagaggttggtgacgggccagtcgccgggcgggcagcccagggcgtccatggcctgctccagctgggcgtccaggtcccacgcgttggcgtggtccaggtcgtcctggagcttgcccatctcctccatcagctcgtcggtgtagttcgtcgccatttcctcggcgatcgcgttgaaccggttgagcttctgcttgatcgggccgacgccgtcctcgacgttctccaggacggtcttggactcgtcgagcttcggctcctgcatgaggatgccgacggagtagccgggcgagaggtaggcgtcgccgttcgacggctgctcgatgcccgccatgatcttcagaacggtggacttaccggcaccgttcggaccgaccacaccgatcttcgcgccgggcaggaagttcaggaagacgtcgtcaaggatgaccttgtcgccgtgtgccttgcgcgtcttgcgcatggtgtaaatgaactcagccaagagaaaccgtccggcagatcgatggtgggcagatacaccccatcttgccgtacgtccataccctcgggcgaatgggtaggccgggcgcccctgacctggaaggtgccgggcggcggggtggggcgggcgggatggcggggaacgcgggggcgcgggcctccgccggcggtttcggagggtggagaagcggcgggcccgctacgtcacggcgaactccggagccggtcggctcctggccggctgagccaccgggccggggggccggggggccggggggccggggggccgggggcgcccccgctcagcgggggcggtagacggtcagggcgtcggggactccttcgaggacgagggcggccggggcctcggcgtactcgccgtcgtacgcgagcggggtgcccgccgggatgtccgcgatgcgcaggctgcgcaggcgggtggccacgtggaccggggaccggctcagcgggcccgtgaaggcggcggccaggagccgggggccgggccggccgccgccgtggaccagccgcaggtcgaggaggccctcgccgaggctgtcgcggcggcggggggtgggaccggtgccgtggtaggtgccgttgcccgcgaagagcagccatgcgctgcggggccgcccggccagccgcagccgcacgggccgctgggaacgcagcaccttccaggccgccagcagcgcggccgggccgccgccgatgcgcgggccccagcgcagccggtggcccaggagctccggataggcgccgatgctgaagttgttcaggaagtagccggtctcgccgtcgggccccggggagaagcggcccacgccgacgcggacggcgtgcccgtcggccagggcccggcaggtggcctcggttccggggaggccgaggtccatcgcgaagtggttgagcgtgccgccggggaacacggccagcggcaccccggcccgcagcgcggcggtggcggccgcgttgatcgtgccgtcgccgccgcagaccccgagcacggcggagcgcgaggccgccttcgcgagggtgacgggcagctcggggccgtcgcactcgatcacctcggcctcggggaggcggctgcgcagtacgtcgaggcccgcggccgcggcggtgcccgacgcggtgttgaccaccacggtgagcccggccccgtcgggcagcgcgggggcgtcggcggccggaggctcgccgccgggcacgatccgggcctcctgcgcgtcccgcgcgaggcggtgtacgacgaaccccgccgccacccccagtgacgcgccgacgagcacgtcggaggggtagtgcaccccggtgtagacccgggagaacgccacggacgcggcgaccggggccagtaccgccccccagcccggggccgccagcgccaccccggtggcgaaggcgaaggccgatgccgagtgcccggacgggaaggaggtggtctgcggctgcgtggccagctgccgtgccaggggcacgccttccagcagcggccgcggccggcgtacggaccacttgcccacggtgttgatggtcgcggaggccagcgccagcgaggcgaccccgcgtacggcggccttgcgggcaccggccgatccgaagaccgcgatggccgcggcggccccgccccacagcaccccgtggttcgcggcccggccgagccgcggcagcacccggtcggccccgggccagtgccgccgggccaccgcgtcgaacagccgacggtcccagcggccgaaggtgccggaccacgtcagttcttgatcagccatcttctgcccttaccccggccggcggatccgaatcggcccgcgcggccacccggcccatccggcccatccctgggggcgggtgacctggtcgggcagggcgtcctacgccccgtcctcctcgtccagcgggcgcttgcggagcagcagcaccaccaggccgcccagcaccaccaggcccaccgccagggaggcgatgacgggggtggccgccgagctgccgctggtcgccagccgctcgtcgtccggggaggtcgtcagggcggccccggactgcgcgcccagcacctcggccgccgagccggaaccggtccccgtgtcgtcgcccggggcggcgcccaccgccgtcaccgggggctccggccagaccgccgtggccgtcgcggcggcggtggactcgctggagccggccacgatctgggcgtgggccggcagctcgccggtgaagacccggccgaccggcaccctggtcgcgccctggacggtgaccgaggccgtcccgtcgggggtgcccgcgggcacctcgaagtacagccggcgcccgttgacggcggtggtcagcggctgtccctcggcgtccaccacccgcacccccatcgcgacggccgccgcgtccgggacgaccgacacgctccgcgccccggtccgcacggtcaccgggccgagccgggtgcccaccgcccccgacacgttgcccgggtccagcccgagcgaggccggcggctccgggagctgcccggcggcccgctgcaggtagtcggccagcttctcggccgccgggtccgcggcctcgacctgtgccccgtccgccagccgccagatcgccacctgggtcccggcggccgcgctctgcgcggtgagggccccggccccggccgccttggcgaggccggccaggtcgttgagctgcgggtaggagtgctccaggacccagcggatccggcccgcctcgctgttcccggcgagcgggctgccgctccagccgctctcggtgtaccgggcctggggctgggcgttgccggtcacgccgaccccgtacgtctggagcgtcccaccgccgtcgacccgcatctcgtagagcccggccgggatctgccggaccgagccgtccccggaccgcaggaccgcgtgcccgaacgtcttcagcccgtccagcacggcgctcgcgccctcgggggacctgggtgccaccgggccggagtcggcggccgccaccgccgcgggggcggtggcgagggccgcggccagcagggccaccgccagcggccggcgcgcggagccccgtaccgaggccggaggttcggtcggacccgcatcaggagcaggagcagcggctggggatggagcaggggctggggctggcgctggggatggaacaggcaccggagcagcagcgagcgcaggaacaggcgcaggcgcaggcgtggagtcgggagcggaggatgcgggaacggcaatcgacacagtcttccccttcgggccaaagacccaagtgcccgtgagtaccggggaatcctatccgcctcgaacactcagaccaccgccgccttctgagtgaccatcagcggagtgtccgtccggaccacgcgccggaaggctgcggtcccccggttcaggtcgtgcccgatggccgtcgcgtcgatctccgcggagaaccaccggttgccctcgccgtcgggcgggtcctcccgcaccctcagccgcccgtgcaccaccagcggctcgccgaccgacacggaaccggcgaggttcacggcgagcccccgtcgcgcccacacggtgtagaagctggtggtcccgtccgtccaggcgtccttgcggcggtcgaagtacctcggcgtcaccgcgaagcggaaccgcgccgccggaccgttcgccgtctccttgtagtcgatctgcgtcgccacacagcccaccagcgtcacctgggtgtcgtacatcccggtcgccctcccccatggtcgcggtccgtacggttgcgcacgaaccagccgtacggaccatccgtacgaggtacgaaccatgctggggcaggtcgccgagtccccgctccggcctgtggattactgccgggttgtggacaacttgctcccccctgcggccaccgtggcgtactgctcccgcacctcccggtagcgcagcagctccgccgccaccggttccagcacccgcgcccgcccgcacccggccgccgcctgccgcagcctgcgctccgcgtcctgcccgtaccggcgcgccgggccccgggcagcgatcgagcaggaccattccacgagcggcccgccgatgatgcccgccaccatcagcaggaccggcggcatcagcctcggttccagaaccccgacgatctgcccgaccagccacagcccgccgtagatctgcagcagggtcatggccgcctggccgagcaccgccgccggccaccacgtgggccgcggcggtttggcactcggtacggccaccgccgccccgagggtcaccgcgatctcgtccagcgcctccgggagccggtcggcgccgcgcaccgcggtctcccggaccgcctgcgcccacgggtcgggcagcccggcgaccgcctcgtcggcgaccacccgtacggcctgctccacccgctgacgcgcggtcacctcctcttcgaccggggcctccggggccgccgtgccgcgcccgccgatcgccgcgagggcggccagacccgccagggtgcggggcgcgcggcggccctcgtaccagcgccacagccgcagccagggcgtcccgcacgcctttccggcgttgcgccgccaggcgcgctcggcggcgagcccggccgcgtacgccccgaccgcctcggcgaggcggtcctcgaactcggcgcgcgccgcttccccgatctccgggccggggtgcccgtcggccacgtacagcgggcgcaggcgcagggccgcgcggtcgacgtcggcggagatccgccgggtggcggcgcccttctcctgggtgaactgtccgaggagctcgcgcagttccccgacgccctccccggtgagtgccgacagcccgaggacggtggcgccgggctcgccgtgctcgccgagggcgatgccgtcctcgtcgaggagccggcgcaggtcgtccagtacgaggtcggcggcctccccgggcagccggtccacctggttcaggacgacgaaggtcacctccgcgtgcccggcgagcggcctcaggtaccgctcgtgcagcacggcgtccgcgtacttctccgggtccacgacccacaccacggcgtcgaccagggccagtacgcggtccacgtggtcccggtgcgcgccgaccgccgagtccaggtcgggcaggtcgacgaggaccatcccgcgcagtgcctccgcctccgaggtctcgcggggcctgcggcgcaggcgtcccgggatctccagccggtccagcagtccggcggctccgtccgaccagctgcacgcgatgggcgcggccgtggtcggacggcgcagccccatctcggagatctgcacaccggcgagtgaattgaagagagtggacttgccgcttccggtggctccggcgatcgcgacgaccgtgtgctggggtgacagcccccgccgcgcggcggcctcgtccaggacccgcccggcctcggcgagggtctttccgtcgagcctggtcctggacaggccgaccagttggcgcagcgcgtcgaggcgcagccgcagggcctggccctcggggctgagcgggggtgcggtcgacttgccgccgtcgctgcccgcgccggagacggcccgtacgagggcctcgtcgccctcgtcgctcccgccgcccccctggcccgcgtcgccctcgtactcctcgtcgtccgggtccccgtcgacggcccggggccgcgagcgcgcgatgagtccgtcgtcccaacggtcgtcggtgcggtcggtcagagcagtcaccgcgtcacctctccttctgcagtacggacagcgcggcgatcagctcggcctgtggttccggggtcacttcgagcgcctccagcggggcgagccggcggtcgcgttcggcgcgcagcacctggtcgaggtggtcgccgaccagttccccgccccggtcgcgcagccgcagggcggcttgcgcgccgatccgttcggcgagcttctcccccgcgggccgggcccgtttgccgccgaggagggcggcgacgaggagggcggcgatgccgtcggggtcgagtgcgggctgcctgtcgctcttgcccacctcctcctcggcgagttcctccaggacccgccgccagcggcgtacggccatcccgatgcgctcgcccgcctcccggtcgggcgcgggcagcgagaccgcgccggcggccggttcgcgccgccaggcctcggcgatccgctcgtcggcggcggcgacggcgcactggaggagtgcggcgagggattcggcgagcgagtccagcagttcgtcggcgctcgtgtcgagcgggtagccgcgccaccgggtcagcgcgtccccggccagtacggcaccgtggtcgaggcggttgcggacccgcttgccctcccgtttgtacgcgtcctcgacggccgaggtcagccgtacggcggcggcgtgctgggcggcgacggcggaggcgagctccggcatccggcgccgcagggagtcgagcgcgccgagcgcggtgcgcccgacggcgtactgccgggcggcggggtcctgggcgtggtgggcgagccaggcgtacagcggggcgacggcgctggccggcagcagcccgcccccgcctgcggattcgggcagctcggggacggtgaaccgcggtacgtcgcccagcccggccttggtgagcagggccccgtactgccgcgagacctcggcgagcacctggtgcggaacccggtcgaggacggtgacgagggtggccctgtactgcttggcggtgcgcagcaggtgccaggggacggcgtcggcgtaccgcgaggcggtggtgaccatcacccagacgtcggcggcgcagatgagttcggcggcgagggtccggttctcgaccaccagggagtcgatgtcgggggcgtcgaggatggccagcccgcgcggcaggctggaaacggtctcgatccgcatctcgcgggtcgcgtgggtgttgcccggtccgcggtcgcgggcccgggatcgggcggcagggggcgtctcctcctcctcgtgcggcacccagacccgcatcaggtcgggcagtacgcgcatgccggcgaaccagtggtggtcgtccggatggcagacgagcaccggtgtacgcgtcgtcgggcgcaacaccccggcttcgctgacctgccggccgacgagggagttgacgagggtggacttaccggccccggtggacccgccgacgacggcgagcatcggcgcctcgggcgccttcagccggggtacgaggtagtcgtcgagctgcgcgagcagctcggctctggtctggcgggcgcgcggagcgccgggcaggggcagcggcagacgcacggacgcgacccggtcgcgcagggcggacagggcatcgagcagctgaggccgaacatccaaggtcaccacatgcgaagaatgcccaatttaggaccatttttgaagcttatacgccccctgcgcgccgaccgcgactccagtgggacattctgggcacgacggacgagtggggcgcaggcataacgagtgcacaacaccaggggcgacgcggcgcaaaagcgatgcgagaatcgcacctgcctgcgattatcgggaccgcttcaccgaacctccacatcgtggcccgcgagtgaagcaaccgggacaaggcaaccggagccctatccttgacccggcacggacctcagccccacccccaccggaggctccaggcccaccaaggccgccttccggcccccgtagctcagtggatagagcaggtgccttctaagcacttggccgcaggttcgagtcctgccgggggcaccacgcttgcaccgcccgaagccctccctccgcggagggctttcgtgcaggtcagcgcaccttaccgaggtctcggtagccgcgcgataagggccggaaggccgcgcggctccaccacttgcccgagccgcttcgggacgaagaggtcgtgggttcaaaccctgacaccccgacagggcaggcccctgttcggcgttcgccgttccgcggtgccggtggggagccgacctgcatcatcggtgcacgtacacgccggaggccgggggaaccacatgggcatgcaagagcggtggcagagcaggcagggcgaactgaccgccaagaacgaggcccgggatgccgaagacgttcagcggcgcgaggccgtggtcgaggccgcggagagtgcgatcgtggcggcggcagatgcgttcggacggggcgacggctggttcgaagccgaggtcgagcagcgcggtaccagcggctggtcggtctacgggctcgccgcggtggacttcggtgggccggctcccacgaggggcggggtcgcccggtcaaggccgggaagggcatcgccgcggagtgacctgctgtcgcggatcgaggatgagggctggtccctgcacaccgcccagtacgtccacgtgcacctcagcgaggagtcccgacccggcgggctcttgtcgggagagcgggtgaccgtcaaggggaagatcgtcggcgtgtacctgttccgcagggcgcgctgattcggattgcggccctcggggagggctttcgcgcgggccgactacgcggacgggccgcggtacttgtagtacgccaggaacatgtccacgccggtctcgctcagggccgtggtggtctcccggggcagagcgaccccgtaggcgctgtggatcaggtgcgggtagagcaccagcgagtagaactggatgatggcgacctcgacgtccggcatgtcgaggcggccgtccgcgatgagccgggcgaaggtgtcgagcagggccggacgggcccggtcggggccggactgcttccaggccaggcccagttcggggaagcggtgggtctcgttgaccaccaggtggcgcagcgccagcacgtctggctggatcatgcccttcacccaggcctcggcggtccacaccagcgcggtgcggaggtcgtcggtctcctccaggcgggcggcggttccttcgatggccgcgcccagggcctcttcgagcgcgtccccgacgacggccaggaagagcgcgtccttgttgccgaagtggttgtagacggtcaccttggagaccccggcctccgcggcgatggtgtccatgccgaccttgaagccgtcccgtacgaaggcggtgcgcgcggccctgacgatcgccagccgcttacgggcggcccggtcgcccgtcggcacccgtggggtctctctcatcaccgctccgctcgtctcggacgccagcctagcagcccctgaactggccggttgagttcatatgaaccgacctgtacagttcaaaagcgccgagtcccacgggggtgggctgggcgccacagccgtccatctcgcaccgctccgcggcgagttcgtccgcccgaagtccagccgaagtccggccgaagtccgcccgaagtcctcgcgacgtcctcgcgcgggcgggccggggggcggcgcggcccacgcggtcgcgggggcccgtaccgacttgcggggaggccggggatgcggttgcgtcgaaggagatgggtacgtggtttccgtctcccctggctagggggtgagccatcgtgctgttcacccatcgcgcggacgccggtgagcggctcgccgaagcgctccggcacctgcgggggaaggacccggtcgtactgggtctgccccgcggcggagtccccgtcgccttccaggtggcccgcgccctcggcgccccgctcgacgtgatcgtggtgcgcaagctcggcgtcccccaccaccgcgaactgggcttcggcgccatcggcgagggcggcgtacgtgtcatcagcgaagacatcgtcctcggcagccgcctgggaccgcaggacatcgcggcggtggagcacgccgaggaggcggagctcgcccggcaggccacgaggttccgcggggagcggccccgggtgcccctggacggccggaccgtgatcgtcgtggacgacgggatcgcgaccggggccacggccgccgccgcgtgcgaggtcgtacgggcgcagggcgcggcgcgggtggtgctggccgttccggtcgccccgcccgacgcggtcgcccggctgggcgccgcggccgacgaggtggtgtgcctcgccacgccgcacgccttccgcgccgtcggcgagtggtaccaggacttctcccagacccccgacgaggaggtcgtcctcctgctcgcgcgggccgcggccgggcccggcacccgcccgcccggcccgaccgccgcagtcgaggtcgaggtcgaggtcgacgacggccgcctcgtcctggccggcgacctcgccctcccggagggcgccggggcggtcgtggtcttcgcgcacggctccggcagcagccgccgcagcccgcgcaaccggtcggtggcggcggacctcaaccgggccggcctcgccaccctgctcttcgacctgctcacgcccgacgaggaggccgaccgggccaacgtcttcgacatcgggcccctggctcggcggctcgcggacgccaccgcctggctgcgccgccgcgaggccctcccgacgggctggttcggggcgagcaccggggccgcggccgcgctgtgggcggccggtgaggcgggcgccgacatcggcgccgtggtgtcccgcggcggccggccggacctggccggcgcccggctcgccgctgtacgggcccccacgctgctgatcgtgggtggccgggattcgacggtgctcgacctcaaccgccgggcccagcgcgagctgcgctgcgagaaccggctggaggtcgtcccgggggccacccacctcttcgaggagccgggagccctggacgaggtggccggcctggcccgcgactggttcacccgccacctgctgccctcgtagaccggaccggtcgctgcagcggtggcggcagcggtggccggcgcccacggcacgcgcgaccatgaggggatggagcagccgtcggcgcaggatgtcagcgctccgggccgcatcgcgtcacccggcgagggcatcgacccgcaggagctggcgctcgcggcccgcaaccacgggctcccgctggaggcgctgcgctacgaggtcacaccgcccgggctgcactacgtcctggtccactacgacatacctgccgcagacccggccggatggtccctcggcgtcggcggccgggtccgtaccccgctggccctgggcctcgccgacctgcgcgccttcccggcggtcacccaccgcgtcaccatggagtgcgcgggcaacggccgggcccgcctgacaccccgtccggtcagccagccgtggctggtcgaggcggtcggcaccgccgagtggacgggcgtaccgctgcgtctggtgctcgccgaggccggggtgcgggcggacgccgtcgaggccgtgttcaccggcgccgaccacgggatcgaacgcggcgtcgagcaggactaccggcgcagcctgcccgtggcgaccgccaccggggacgaccccgaggtgctgatcgcctacgccatgaacggcctgcccctgcccccgcagcacgggtgtccgctgcggctggtcgtgcccggctggtacggcatggcgcacgtcaaatggctgcgcgagatcaccctcgtcgacgcgccgttcaccggattccagcaggtcgtggcctaccgctaccggtcggccgccgacggtccggacgaccccggcgagccggtcaccctcatcgcgccgcgcgccctgatggtcccgccgggattccccgacttcatgtcacgcacccgtgtggtgcggcccggcccggtaccgctggaggggcgggcctggtccgggcacggggccgtcgaccgggtggaggtgagcgccgacgggggccgctcctgggcccgggccgaggtcacggcgccggggcggcacccgtgggcgtggcaggcctggtcctgcgtctggacggcgacgccggggcaccacacgctcaccgtccgcgcgacggacaccgagggcggcacgcagcccctcgaacagccttggaaccggggcggtttcggcaacaacctggtccagcacgtcccggtcctgtgctgctgagcggaggccgtcggcctcaggagatgccgaaaagcctgaccgcctggtagtaggtccacgcggtgccgtcgcaggagctcctgcgggagcccgagtactgcgcgcagacccgcttcaggtccgcgtggaacgccaggtccagcctggccttggcggccgggaacagccctgccgcgcggtggttgcggtagccgaagtcgtggcgcgcgcaggcgtccgcgaaggggaagccgaaggggttgtcgggggacgaggtgcactggtccgtcgaccagtcgaagccgtacgcgacccaggcggcgcggtgttcgcgcgcctcggcccatgcctggtagctggcggcgctggtctgcgtccagcggctgagcacctgcggcttgtcggccgggacctgcggtgcgacggcccaggccgccggggcgagggcgagcaccgcaccggcggtggcggtggcgagagcggggacgagacggcggcgaaggaggcaaaagcggcgaaggaggcgaaggcgcatggaattcctcgggccgggggcggacggatcacttccggcaactcccccgggcaccccgcggttactgtgcgcgcccgggcggcgcggatggcacgtgctgcccgggcgcggggggctcagtcgcgcgccagcgcctccgccgtggcccgggcgaagccgtccgggttgtcgagcatgatgttgtgcccgcagtcggggaccggcaccacggccacgcccgaggcctccagggcatcggcgcccgggagcggaccgtccgcctcgggcagcaggtaggtgcgcgggatcttcgactccagcagcagctcacgcatggtgggcgtggtaccggcggccaggtggacggccgtgcggtacagggcggtccggccggccagccgcatcgtggaccaccagtgcgcgccgacccggtcccgcacctcggcccagcccccggccaggaactcctcctccgtgtaggaggcgatcccgctgctccccggcgcgacgggcaccggccgctgcggatccaggttggcgtcgacgagcaccagccgggacaccaggtgggggtgccggtccgcgagcacgatggccacggccccgcccatgctgtgggcgatcagctcggccccctccgcaccggcctcggtgagggcggccgccagcgcgtcggcatgcgcttcgagggtgtagccgaatccctcgggccggtcgctgtgcccgtggccgagcaggtcgaccagcagcgaacgccgccccgccagcagcggatgggtggcactcgccgcgaagtaggcgggcgaggtggccccgagcccgtgcacgtacacgcgcgccggctcctcccccgccagttcgacccagcggatccggtcgccctccggcgtgaccacggcgttcctcacgatgctccccctcgggtctcgacgacccggacaggctacgggccacccggggcacgggcgtgtgccgcggccgccacgccgtgccgtccatcggctgaccatccgtcatgtgcgcactatcgtggccgccatggacatccgccgggccctcacctccgccgagctcacagccgccgagtccctcttcgacgggcctgcccgcacggagtggtccgagcgcttcctcgccgccccggggcacgtgatgctcatcgcctacgtcgacggcgtgcccgccggcatggtctccggcatcgagatgagccaccccgacaagggcaccgagatgtgcttgtacgagctctccgtggacgaggggtaccgccgtcgcggcatcggccgcgacctgaccctggcgctcgccgaggaggcccgggcacgcggctgctacggcatgtgggtgggggtggacaccgacaatgaggccgcccttgccacgtacggggccgccggcgcccgcgacgagggcgtcttctcgatgcgcggctggcccctcgccccgtagcgccggggcccgggggccgcgcaccacccgcacaccgcctcgcacacccgcccgcgcacccgccccgcacacccctccgcgcaccgcctccccggcaacctccggcccttgcccggcgcttagggtgttcgctggtcggcccgtcgggcggccaggggatcgggggaggccgatgaacagcgcgaccgaggtgttcgagccgctacgggcggacgatccgtccaccgtggccggataccgcatcgcggcccggctcggcgcgggcggcatgggccgggtctacctgtcgcacacccggggcggccgcccggtggcgatcaaggtggtacgtccggaactcgccgaggacgccacgttccggcggcggttccgccgcgaggtggaggccgcccggcgggtccgcggcgcctacaccgccgagctgatcgacgccgacgcggacggaacgccgccctggctggccaccctctacgtgcccgggccctcgctgtcgcaggccgtgaaccggcgcggaccgctgccggtgcccgccgtgctgtggctgatggcgggtgtggccgaggccctgcaggccatccacggcgcgggcatcgtgcaccgcgacctgaagccgtcgaacgtgctgctggccgccgacgggccccgtgtcatcgacttcggcatctcgctgtccgccgacgccaccacgcacaccgccacgggcgccaccatcggcacgccccagtacatgtcccccgagcaggcgtcggcgggtgaggtcacggcagccgccgacgtcttcgcgctgggccagaccgcggcgttcgccgcgctgggcgagccgctgtacggcaccggcccctccgcgacggtgctgtaccggatcgtgcactccgcgcccgacctctcccggatcccgcaggagctgcgtccgctgatcgcccggtgcctggccatcgatccgcaggagcggaccacccccgcggagatcgtggcgtggtgccggaagcaactgggcgaggacgccgacgaggacggcggcccggcgctctggcgcgaggtgaccggaccggagctgacggtcccggaacccgtacccgtacccgtacccgtaccggagccggccccggagccgggcccggcccccgccgcctcgcccctcgcgccggcggcccagccgtacacgctgcaccaggtgtggcagcctccggagccgtcggctccggaagaaccggggcaacggcgcaagcgccggtggcgcaacgcgctgatcgccgcggcgtcggtggctaccctcgcactgatgctgggcgggctctggtcggtcgcggacaaggcgatggacggcctgcgcgaccgggcgaagtccccgaccaccgagaagacaccgacggggccgacccgcccggcgagcggcgacccgacccggaagagcaccggatcctcgccggactcgaaagcgaacgcgaacccgagccccaacccgagtccgccggcgagcccgtccccgagctcgcccccgaaggccgtgccctacccctcgctggtcctggacgaggagaactcgatcgccctcaaggaaccggtccagctcgccactcgctccggggacctccgcctgaactgcgaggacgtgggctgtgcgctggagagcgacaccagtgtgatcgcccagctgacgggcaagccgcacggctccctcgactcctgccggaccgccgtggaggggagaacggccacacggagccaggacctgggctcggcagcggccgggagcgagttctgcgtcaagcaccgcgcgacgggggacatcgcgctgctcgtgctcacgctcaagtcgactccgtggacggcggacctgggcctcccgagctccctgagggcggacatgacggtctggcgggcggcctgacggagcgaccgtccgggtccgggcgtgccgggtccgggcgtgccgtcccggcgcgggccgggatccacccgcgggtcggcgtgtcgtgcgcccgctcggcgcaccctccgcgcgcccgcgccaccgctcgcagagcatcggccgcatgaccgcattcgccgcactgctccccgccgccgcccttctcgcggcggccaccaccgccaccgctcccgtcacgggcgcccctgcggctccccgctccgccaccgcctcctacgtcgtcgtcctcaaggacaccacctcgcgcgcgccgacccgcgtcctggccgccgaggccgcggacgcgggcgacgaggtcggagccgtctacgacgccgccctgaacggcttcgccgtccgcacgacggccggccgggccgccgccctggccgccgacccccgggtggcctccgtggaaccggacgcgaggttccacaccaccggcgccaccgacacccctgacacccccggagctcccggagcccccgaaccgcaagtgctgcagcaggctcccgccccctggtccctggaccggatcgaccagcgcgaactcccgctcgacggctcgtacacgtaccccggcagggccgagggcgtcaccgtctacgtcgtcgacaccggcatcaacaccggccacctggaattcggcggccgggcccgcacgggctacaacgcggtgttcctcggcagctcccgcgactgcagcggccacggcacgcacgtcgcggcgaccgtgggcggggcgacgtacggggtggccaagggggtctcgctggtcggggtgaaggtggccgactgccgtggtgacgctcgcctgtcggcgatcctcaagggtctcgactgggtggtgaaggacgccgccaaggccccggccaccccggccgtggccaacttgagcatcggcggcacccgcagccgcgccctcgacacggccgtgatccgggccgtggcctccgggatcaccgtcaccgcggccgccggcaacgacggcagggacgcctgcggcggatccccggccgccgtgccccaggccatcacggtcggcgcgaccgacgcccaggaccggcgggcgccgttctccgaccacggccgctgcgtggacctctcggctccgggcgtgggcatcacctcggcctggaaggactccgccaccgccacggcccgcgcctccggcacctcgatggccgccccgcacgtggccggggtcgccgcactcatcctggcgcgcggtacggcacgcaccccggcgcgggtgtcccaggaactgctgcacagcgccgtacccgaccggatcgcgcagctcccggccggcaccccgaacctgctgctccacacccccaccgcgcgctagtccgaaccgcgcccgacccgccccgaccggtcggtatccgatgggccatcagactccccctgatggcccatcaatttctgtgtgcttcgggcgaaagcaagtcattgacttctcatcacggcgacgcgtcaatatcggccaccgcaccggctcggcctcccccacacagcgggtggggggaggggttcgtcatgacgaaggagtcgcgacccagtgagtacgagaacgctcagacgaagagtgctggccggggcgggagccctgtctctggccctgacgggcggcgtggtggccctgacgggatccgcgcaggccgcgaccaagaccacggctgtcttcgagaactgcgacgccccggcgccgcagccggacggctcgggcaaccagaactggacggtcaccctgcccgacggcgccaaggccggcgacgtcgtcccgatcacgatcgacccgggcgcgagcccgctgatccccgggttctccgtcaccacggtgaacacctccaagatcaccctcaaggtcggtaccaccacccaggtggtgaccagcccgccggagaccgtcagcgtcgtggccgggcagccgctcgaccccaaggcgttctccggaacgatccggattccggacggcaccgagggaaccacggtccaggtcgccctcgacctggcggtgaccgacgcggacctctccggttcggtgttcaccaccacctgtaccccggcgccgcgcccgagtgcctcgctcggctcggtcgcggtcgaggccctgcccaaggacccggtcaccacgaagctgacgcccaacagcggcccggcgggcaccgccgtcaccgtgaccggcgccaacttcccggccggcgccgtcacctgctccgccctgctcgcgggtgcggtgaccggtgacaccggcgcgggcacggccgacgcgtccggcgcggccacctgcaacatcacggtcaccaagaaggccgacgcgatcaggatcgacggttcgatcaccccgtacaaggccttcgtgttcctggaggagcaggccggtgtgaagaacccggtcgacgtcgaggtcctgccggggccgctggccctcggcccgaaggacggccagccggccgtcagcttcggcgcggtcaccatcaacggaaaggcccagtcggtggtcggcgtcttcaacgcggcgaccgtccaggacttccgcggcggctcgctcggctgggacgtgacggcgacgcgtacgccgttcctgaaccagaccaccggccactcgatggcgaaggcgcagatcggcatccagccgtcctgcaccgtgaccaacccggacagcccgagcacgtgcaccgcgggcacgcccggcgcgatctccgacgtcccgatgaaggtggcctcccaggccgccggcggggacgagctgaccggcggtgagttcgccgtcggcggcgccgggatgatccagctcccgcccttcatgttcgcggacacctaccagacggtcgtgaccttctcgatcgcctgacccgtccggccgctcggccccagggtggtgcggcgctccggcgccgcaccacccctttcccctttccgcgcccaccggagacgagaccgcccatgcgcacccgcgcccgcacccgcacccgcattcgtagccgcatccgcaccctcctgtacggtctgctcctcggcctgctgtccggcggcgcgggcctgctgccgcccaccgtggcgagcgccgcggacaacggcacgtggggggtcttcccgacgccggcggccggggcggcgatgaccgaccgcgcgtacttcttccatcagggcgcggccgggagcacgctcggcgacagcgtggcgatcgtgaactcctccgacaaggagctgacgttccaggtcttcgccaccgacgccgtgaacaccccggcgggcggcgccttcgcgctgctgccggtcgaggcgaagccgaaggacgtcggcgcgtgggtcacgctggcaccggagaccgcgagcaccatcaccgtgcccgccaagggccgcaaggacatcccgttcaccgtgaaggtcccggcggacgcgacgcccggtgaccacgtcggcgggatcgtcgccctcggcaccgccgtcgagggcgtacagcaggagggcaaggtccaggtcggggtgaagcgctcggtgggtgcccggctgtacttccgggtgccggggcccgtcacggcggggctgagcgtggaggacgtgcgggtcagccgctcggcgccgctgctgccctgggtgcgcgacgcccgcgccaccgtctcgtacgcgctcgtcaaccggggcaacgtggtcgtcgagccccgggtggcggtgtccgcggagggattgttcgggcgccaggtgctggaccggcccgcccgagagctgaagctgagcctgctgccgggtcagcggatcgagctgacggaaccgtggccggacgccccccagtcggactgggtgaccgtcaaggtcacggcgggcgcggcggcccaccccgatctggtctcggagtccgggaccgagttcgtcgccgtcccctggccggccgtgggcctgctcctggtactggcgggcgcgggcgccacggtgtgggcgctgcgccgccggcgccgcgcggcgcccgaacagccgcagtccgtaccggacgtggccggaacgcactgaccggcgcgcatgcccccgggtgacctccttcgccctcaccgacgggcgggtaggcacctcatgcaacgcctgcactgcggcccgggggctcccgggtgccctggccgtcggaccgcccccgcgcctcacccgcgcgggggctcacccatgtcgtgctgagccgcgccgccggaaacgatcgcggcgccgtcacgcccaggagcgaaggcctgtcgcctccctcgcctgtggcctggtgagttgtgctcagcgtgcgcggacgactacggtttctcgcgtgtggcccgccaggggagtccagcgtgatgctgggtccaactcccgccggtttccgcgtgagcgcggtaccggaggcacacagaggatcgtctggcgatggggcaacgcggccccaagtcccgacatgcgtcatttcgcatgcacgcccccaggcgtgcgtgtgccagcccgcagcccacgttgtgattggtagtaacgcaagctgcaaggtcggaccctgccgtctccgacctcaacgagtacgccctccacgggcggagcacagtcgtgcgggcgctgtgcttccgacagattcgtctgtcttcgttgaggtcgctccgtgctgttctgacacagtcgggcattcctcccacgaagacgacctgagacgtcccgggagacgttcatgtggtccgttatgggtgagctggcattgaacggcggcatgctgctgctgtggttcctgctggtgctggcgctcatgttcatcagctgcctgacgatcgcgctctacaaggccccgccgcgcacgcgccccgagatcatccgggcccttgccgagctgatgaccttctggaagcggaagtagcaggcacccggccggggacagcaggcttgaggaactgtggccggggacagcgggaacccccggccggtgaggggtggccgggggttgctggctgctgggggcggggtgggtcagtggttgcgggggaagcccaggtccacgccgaggtggccctcggaggggtccggccagcgggtcgtgacgaccttgccgcgggtgtagaagtggatgccgtcgttgccgtagatgtggtggtcgccgaagagcgagtccttccagccaccgaaggagtggtagcccaccggcaccgggatcgggacgttgacgccgaccatgccggcctcgatctccagctggaagcggcgggcggcgccgccgtcgcgggtgaagatcgcggtgccgttgccgaacggcgaggcgttgatgagggccacgccctcctcgtaggtctcggcgcgcagcacgcacagcaccgggccgaagatctcgtcgcggtaggcgtcggagtcggtcttcacccggtccagcagcgacaggccgatccagtgcccattctcgttgccctcgaccgtgaagccggtgccgtcgaggacgacgtccgcgccctggtcggccgcgcccttgacgtacgaggcgaccttgtcgcggtgggcggcggtgatcagcgggcccatctcggaggtcgggtcgttgccggggccgatcttgatcttctcggcgcgctcgcggatcttctcgacgagctcgtcgccgatcgcgccgacggccaccacggcggagatcgccatgcagcgctcgccggccgagccgtaggccgcggaaacggccgcgtcggcggcggcgtccaggtcggcgtccggcagcaccagcatgtggttcttggcgccgcccagggcctggacgcgcttgccgttggccgaggcggtggtgtggatgtggcgggcgatcggggtcgagccgacgaaggagacggccgcgatgccggggtgggcgagcagcgcgtcgacggccaccttgtcgccgtggaccacgttcagcacgccggccggcagaccggcctcgctcgccagctcggccagcttgttggcggccgacgggtccttctcgctcggcttgaggatgaaggtgtttccgcaggccacggccagcgggaacatccacatcgggaccatcgccgggaagttgaagggggtgatgccggcgacgacgccgagcggctggcggatcgaggagacgtccacccggttggagacggaggtggacagctcacccttgagctgggtggtgatgccgcaggccagctcgacgatctccaggccgcgggcgacctcgcccagcgcgtccgagtggaccttgccgtgctcggcggtgatcagggcggcgatctcgtcgcggttggcgtccagcagggcccggtaggcgaacagcaccttggtgcgggcggccagcgaggactggccccaggtgaggaaggcctcccgggcgacctgtaccgcggcgtcgacctcgtcggccgaggcgagcgcgacctgcgtggtgacctcgccggtggccgggtcggtgaccgggccgtagttgcccgacgcgccctcgacggtcttgccaccgatccagtggttgacggtcttcattgccttgctccttcacagatggcgacgtcgctgagcggcttgccggtcgtactcttcacgggccgtggcggcggccttgcgggtcgcggtctcggccacaggaacatcccaccacgcctgtgccgggggtgggcccgacacagtgtcgggcgttcgggtctgtacgtagacacatgtggggcgggtcgcggtgcgggcctcggcgagggcttcgcgcaggtcacgcgtggtgcgggcgcggatcacggccattccgagggaggcggcgttggccgcgaggtccaccggaagggggtcccccgtgtagccggagccggccgcccggaaccggtacgcggtgccgaagccctcgccgcccaccgctcccgacaggccgccgatggaggcgtagccgtggttgtcgaggatcaccaccttgatcgggatcccctcctgaacggccgtgacgatctccgtcggattcatcaggtacgtcccgtcgccgaccagcgcccacacgggccggccgggggcggccagcgccaccccgatggccgcggggatctcgtagcccatgcaggagtacccgtactcgacgtggtactggtcctgggaccgggcccgccacagcttgtgcaggtctccggggagggatccggccgcgttgatcaggatgtcggtgccgtcgaccagggagtcgagcagcccgagcacctgggcctgggtgggcgcggtgtcctcctgcccctccgggacggcgtaggcccgctcgacgcggctctcccagcgcccccgctccgccgcgtacgcggccccgtacgccgggtccgtacggtggcccgcgaccgcgacccggagctcgtcgagcccctcgcgggcgtcggcgaccaggggcagggcggcgagtttgtgggcgtcgtacgggtccaggttgaggccgacgaaccggacggccggattctggaagagggtcgcggaggcggtggtgaagtcggtcagccgggttccggcggcgatgacgaggtcggcctcccgggcgagcgcggcggcggtggaggtcccggtgtggccgatcccgccgacgtcctcggggtgcccgtacggcaggacgcccttgcccgcctgggtgacggcgaccgggatccccgtggcctcggcgaaggcggccagggccgcgcgggcctcgctgtgccggatcccgccgccggcgatgatcagcgggcgcgcggagccccgtacggcctcggcggcgcgggccagctcgtgccggtccggccggggccggcgcacgccccacacgcgctcggcgaagaactcctcgggccagtcgtacgcctgcgcctgcacgtcctgcggcagcgcgagggtgacggccccggtctgcaccgggtccgtgagcacccgtacggcctggagggcggccgggatcagggcctcggggcgggtgatccggtcgaagtggcgggagacggggcgcagggtgtcgttgacggagaggtctccggcgtacggcacctccagctgctggagcacggggtcggcgggccgcgtggcgaaggtgtccccgggcagcagcaggaccgggatccggttgaccgtggcgagggcggcgccggtgacgaggttggtggcgccgggcccgatggaggtggtgacggcgtgcgcggagaggcggccgcactggcgggcgtatccgacggcggcgtgcaccatggcctgctcgttgcggccctggaggaacggcatggcctcgggcccggactccaggagggcctggccgatgccggccacgttcccgtgcccgaagatcccccaggtggcggcgatcagccggtgccggtgcccgtcgcgctcggtgtactgggaggacaggaagcggacgagcgcctgcgcgacggtgagcctcaccggtggtcctccgctcgggggtacgtggggtagggcagccgggggtcgatgtcctggccgtcccaggtgccgcggatccagccgtggtcggggtggtcgcggatgagccactcgcgggtcccgcccggtccggccatgacgttcaggtagtacatgtcgtgcccgggggcggccatggacggcccgtgccagccgtcggggatcagcaccgcgtccccggtacgcacctcggtgaggatgtcggtcttcccggccggggagggggtgacgcgctggtagccgagcccgggggtgtccccgtgcggggcgatctcgaagtagtagatctcctccaggcgggactcctcgccggggtggtgctcgtcgtgtttgtggggcgggtacgaggaccagttcccgccgggcgtgagcacctcgacggcgatgagacggtcggcggggaaggagtcggcggcggcgaagttgttgacctggcgggagcagtgaccggcgccgcggagctccacggggacggctccggccgggccgtagcgggcggggaggcgcgtctcacagcgggctccggcgagggcgaagcgccctccggcggccgcttcgatttcggcgtggccgtcccggggcaggtacgcgaagtcggtgggtccgtcgaacaccccggtccgtccgtgcagttggaacacctccggtccgttcccggggctctgccccgggccccgcgccccaaacgccgtcggggccggattcgggcagcggacctcgcatccgcccgacagcgggagcacgatccactccgcctccccgcacgcatgcgcgtacacctctcccggggccaggtcgaggaccatcagcctcgtccattccatgcgccactcagacaccaccggcacgccctgccacctcctccacctcgtccgcgaacggcatcgcggccgcgcacgccagccgcgaggcgacgatcgccccggccgcgttcgcgtaccgcatcacccgttccagttcccaccccgccagcagcccgtggcacagcgccccaccgaacgcgtctcccgcgcccagcccgttgagcacctccaccgctactggtgggacctccgcgaccgtgccgtcgcggtggaccgccagcacgccctccgggccgcgcttcaccaccgccagttccacacccgcggcgaggagcgcccgcgccgccgcgtgcggatcggactcgcccgtggcgatcgcgcactcctccacgttgcccacggccacggtcgccgagcgcagcgcccgctcgtagtacggttcgggcttctcccgccacagcatcggccgccagtccaggtcgaagaccgtcgtcccggtccgggcgcgggcctccagcgccgccagtgtcgccgcccgggagggctcctcgctcaggcccgtccccgtcatccagaagacgcgggccgcccgtaccgccgtcaggtccacctcgtccgccgcgatctccaggtccggggccttgggcgaccggtagaagtacagcgggaagtggtcgggcgggaagatctcgcagaaggtgacgggggtcgggagcccggggacctcggcgacccaccggtcgtccaccccgaaccccctcagttcggagcgcagatacccgccgaaggggtctgcgccggtacgggtgatcaccgcgacccggcgccccaggcgggccgccgcgacggccacgttggtcggggagccgcccaggaacttgccgaacgtctccgcctcggccagtggtatgcccgccgtcaacgggtagagatccaccccgatccggcccatcgtgatcaggtcgaacgcgaacggatcgccggtcccggtcacagtcagtcctcctgttggtcctccaccctaaggtggccgttatgacgtcctccccgcccgcgttgacccgtatccgcatcggttcggctccggactcctggggtgtctggtttcccgacgatccccggcagaccccgtgggaacgcttcctcgacgaggtcgccgacgccgggtacgagtggatcgaactcggcccctacggctatctgcccaccgatcccggccgcctcgccgaggaaacggccaagcgcgggctgcgcgtctcggccggcaccgtcttcaccggactccatcacgggccgtccgtgtgggaggacacctgggagcacgtgtcgcggatcgcggcgctcacccgggccatgggcgcggcccatctcgtggtcatcccctccttctggcgggacgacaagaccggggacgtgctggaggaccgcaccctgaccccgggccaatggcgtgaactgacctcgcagaccgagcgcctcggccgggaggtccaggaccggtacgggctgcggatcgtcgtccacccgcacgccgacacccacatcgacacccccgcgaacgtggcccgcttcctggacgccaccgaccccgggctcgtctccctctgcctggacacggggcactacgcgtactgcggcggggacagcgtgcgggccgtggagaccttcggggagcggatcggctacctccatctcaagcaggtggatccgcggatcctcgccgaagtcctcgccgaggagctgcccttcgggccggccgtgggccgcggggtgatgtgcgaaccgccctcgggggtgcccgcgctggaaccggtgctcgcggcggcccagcgtctggacgtggacctcttcgccatcgtggagcaggacatgtacccctgttcgcccgaccgtccgctgccgatcgcccggcgcacccgcgcctacctccggtcctgcggcgcccgctgacccttcggaaggaagaggagtacgagatgagcacgctcggcatcgccgtcatcggcaccgggaagatgggcgccgaccacgtccgccggatcgggcggacggtgggcggggcccgtgtggtggccgtggccgacccggacggggaccgggtcaaggaggtcgcgggcaccctggacggggcgacggcgcacacggacccggcggccgccatagccgcgcccggtgtccaggccgtgctgatcgcctcgcccggacccgcgcacgaggaggcgatcctgcacgccctggagcgggagctgccggtgctgtgcgagaagccgctgaccccggacccggcgggggcgctgcgcgtcatggaggccgaacagcggctggggcggcgcctggtgcaggtggggttcatgcggcggtacgacgccgagtacacacggctgaaggagctgctggacgcgggcgggatcgggcgtccgctcttcctgcactgccggcaccgcaatgcctcctcgccgtcgttcttcacgagcgacatgctgatcagcgactcggtggtgcacgaggtggacgcggcccgctggctgctggggcaggagatcaccgcggtcaccgtgctctcgccccggccctcggcggccgccccggaggggctgagcgatccccggctggtgctgctggaaacctccggcggggccgtcgtcgacgtggagatcttcgtcaactgcggtttcggctaccaggtgcagtgcgaggcggtgggtgaggcgggcagtgcccggatcggtgacgggcacgcgatggtggtgcagtcggcgggccggtggggcggcgcgatcgaccaggacttcacggtgcgcttcgccgatgcctacgaccgccagctgcggagctgggtggccgcggcacggcgcggccgggtggcggggcccgacgcgtgggacggctacgcggcggccgccgtctccgaggcgggcctcgcggcggcacgcggcggcgtacggaccgcggtggagctgacggaacgcccggccctgtaccgctgacggaacgccggttcccccacgtatccctgtgactctcttgtcacagggatcacccttctgtcactcatgtccgcattacgcgggtcttccgtcacaggaggtcgacagcccctcccctgtgatcactccgcgtcgttccccgggcacaacccgagtgatcgtcagtgtccacgcgccggctcccccgacggcctcccggccggcccccgcggcgtggacgaggaggtgtccagcatgagcgaccgacagctgtggtcgtacaaggagatcgccgcccacatccgggtccaaccggacaccgtgcggtcctaccgcaagcacgggttgctgcccgcgccggaccatgtggagggcggcaaaccctactggtacgccgataccgtgcgcgcctgggtggcccgccggcccgggaaccggggccggcgcgaggactgaccccgcggggacgggtgaggcgcccctcccggcctcacccgtcccgcccccgctgctcgccccgcccctccccgctcctcctaggtgccgaccgccacggagatccgttccggttcctgtgccgggggcgcggactcgccctcgctcaggccgaaccgctcgtgcaggcggcgcagcggggcgggggcccaccaggtggcccgtccggtcagcttcatcaccgccgggaccaggaggctgcggacgaccatggcgtccatgaggaccgccagcgcgatcccgagtcccagcatcttggtgttggtcacccgggaggtgccgatggccaccatcaccaccgccaggatcacggccgccgcggtgatcagcccgccggtgcgggccagccccgtccgcacggcgctctcgtggtccccggtccggtcgtactcctccttcatacgggatatgaggaacaccccgtagtccatggagagcccgaaggcgatgcagaacatcagcaccggcagggtggtctctatgtcgccggtggcggtgaaggagaggagtccggagaggttgccgtcctggaacacccacaccaccgcgccgaacatggcggtcaggctgagggcattgagcagcaccgcctgcagcggtatcagcaggctcccggtgagcaggaacaccagcagcagcgtggcgaggaccaccagggccgccgccgcgggcagtgcgccggcgatggcctgctgggcgtcgacgaggacggccgcctgcccggtcaccgaggtcttgaagtcggcgtccacggcgcggacgtcgtcgaccaggtcccgggccgtctgtcccacggcctcgccctcgacggacaccgagaaggaggtgtacgcgcttcccgtcggggagccgatcggcccgtcgacccggaccaccccgggcagggcggcgagccggtcccggtaggccgcgaggtccgcgggaccggaggcgccctcggcgagcacggtgagaccgccgccggggctgttcgggaagccgtcgcggatctgctcctgcaccacgtgggacggggcgttctcgggaagctgccggtcgtcgaccgtgccgaactcgaccccgaggaagggcagtcccaggagcagcaggcccgcggtggtggctatggcgaacacgggggcgcggcgcatcacgagggcggccgtccacctccagcccctgcccgtctccgcgggcccggcgggggccgcggccggccggccgcgccgccacagccggcgcaggtcgagggcgttgacccgctcgccgaggagcacgagagccgccggcagcaggatcagcgcggccgccgcggcgagcaggaccaccgcgaccccggcgtaggcgaaggagcgcaggaagtacatcgggaagaagagcatcgcggagagcgagacggcgacggtgagcgccgagaagagcacggtgcggccggcggtgcgcagggtggccccgaccgcggcgaccggatcgcgcccggcggcgagttcctcgcggaacctgcggacgatgaacagggcgtagtcgatggcgagtccgaggccgagcgcggtggtcaggttctgggcgaagaccgagacgtcggtgacctcggtgagtccgcgcagtacggcgttggtgccgaggatggccacgatgccgacgccgagcggcagcagggcggcgaccgcgctgccgaagacgaggacgagcaggacgagggtgaccggcagggcgatcagctcggcgcgcagcaggtcctcctggatggtccgggtgacttcgcgctggaccgccgcggggccgccgagggacacgcgcaccgggccgtgctcgccctcgaagtgcggggccatgcggtccagggccgcggtggccgtcttctcgtcgccctggacgcgggcgacgacgagtgcctgtcggccgtcctcggaacgcagtgcgggctgccgggtgcgccagtacgagccgacgccgacgaccccccgttcggcggcgagtgcggtggcgagccgctcggcctcggcggcgacggcggggtcgtcgaccccggtggtgccctccccggcgtcgacgagcaggagcagattgggctcggagtccgggaactcccgttccagggccttcgtggcgtaggtggactgggcgcccgggtcctcccagccgccgcttcccagccggtcggcgacgccgccgcccgcgaccacggccagggccgtgaccagcagggcgagcagcagcgtgagccgcggccgggccgtgacgaaccgggtccaccccgcgtccgtcccggaggacggcggtttcttgacttcggacatgactcggtgtccccttcaccgtgattgccaggccacttagactggcaaacacgagcagtcgctcgcgtttctcaagaatgcgagcgatctctcgtgtttgtcaatcacccacgggaagcaggggattggacatgccggggacacgcatgggcaaaaactccgaaaaagggaccaagagccctgccgccgcagcaacggccacgaccaccgccgccgacaccggcaccgccgcccctccgcgccgccgccaggcccgcggcgaacgccggatctcccagctactggcggccgccgccggggtgttctgccgtaccggctacgcctcggccagcaccaacgccatcgcccgcgaggcgggcgtgtcgccgggcaccctctaccagtacttccccaacaaggaggccatcgcgatcgagctcggcggccagctgctccagcgcgcgcacgagacgcacggacaggccttcagcccggagaacctccagcgccccctgcccgagctgctcgacgccgtcctcgacccggtcatcgccttcaactgcgagaacccggccttctgggccctcatgcacggcaccggcgtccccggcatcgcccaggagcacgaggagctgcacaccggcctgctcacccgcatcgagaccgtcctgcgcgacttctgcccccaggccgcggcccacgagatcacccacacctcgaacatgatcctgggcatcttcaagtcgtcgctcgacctgatcctggcgcacgagggcgacgagcgcgccgcctacacggccgagctcaagaccgtcctgctgcgctacctggagccgatgatcaccacggctcccccgcactgacccgcccggccgacccgcccggcccgcaccgccccggcacccccgcgcgcccatcgggtgatccgtatcggccatttacatacagttcgcccccaccgccccgttttcccctcaggatcgaaacagtgggagccgtcgctcgccttgataccccctaggggtatagtctcgaagggtcgggaggacggcggagcccatcggccgccctcccggtgaccggcacacgcccctgaagaggagaacgacatgaccgccgagacggacacccagaccaccaccgtctaccgggtgaccggcatgacctgcgggcactgcgagggcgcggtgaccgccgagatctccgccctcccgggcgtcagcacggtcaaggccgtcgccgcgaccggcgaggtcaccgtggtctccgccgccccgctcgcggacgaggacgtccgcgccgccgtggacgaggccggctacgagttcgccggacaggcctgagcggcgcgccccacccgcacggcacccgcggcagccccgcggcaccctgccgggccgtgccggccagctcatactggtcccgtacggcccggccatccccctggagccggaacatgagcagcagcactgtgcacgacggaccgataacggcggtcgaactctcgatcggcgggatgacctgcgcctcctgcgccgcccgcatcgagaagaagctcaaccggatggacggcgtcgaagcctcggtgaactacgccaccgagaaggcccgcgtctcctacaccggtgacgtacaggtcgccgacctgatcgcgaccgtcgtcaggaccggctacaccgccgaggagcccccgccgcccgccccggaacccgccgtctccccccaagagggcgaagacggcgacgaggtacggaccgaggcccccgacccggtgctcgccgcgctgaggcagcgcctgctgatctccgccgcgctcgccctgcccgtggtcctgctcgcgatgatcccgtccctccagttcgacaactggcagtggctctccctcaccctcgcggcccccgtcgtcgtctggggcgggttccccttccacaaggccgcctggaccaacgcccggcacggcgccgccaccatggacaccctggtctccgtcggcacgctggccgccttcacgtggtcgctgtgggccctgttcttcgggcacgcgggcatgcccggcatgcggcacggcttcgacctcagcgtctcccgtacggacggctcctcggccctctacctggaggtcgcggccggcgtcgtctccttcatcctcctgggccgctacctggaggcccgctccaagcggaaggcgggcgcggccctcaaagccctgctggagctgggcgccaaggacgtcgtcgtcctgcgcgcgggccaggaggtgaggatcccggtgagcacgctcgcggtcggcgaccggttcgtcgtccggcccggtgagaagatcgccaccgacggcaccgtcgtcgagggcagttccgccgtggacgcctccatgctgaccggcgagtccgtcccggtcgacgtcgccgtgggcgactcggtcaccggagccaccgtcaacgcctccggccgcctggtcgtcgaggccacccggatcggcgccgacacccagctcgcccgcatggcgaagatggtggaggacgcgcagaacggcaaggccgaggtgcagcgcctcgccgaccagatctccgggatcttcgtacccgtcgtcctggtgctggccgtgggcacctggatcacctggatgctgatcaccggcgaccccgccgccgccttcaccgccgccgtggccgtcctgatcatcgcctgcccctgcgccctgggcctggccaccccgaccgcgctgatggtcggcaccgggcggggcgcgcagctcggcatcctcatcaagggccccgaggtcctggagtccacccgccgtgtggacaccgtcgtcctggacaagaccggcaccgtcaccaccggccggatgaccctcgacggcgtcttcaccgccgcaggcgtcgacgagagcgaactcctgcgcctcgccgggtccctggagcacgcttcggagcacccgatcgcccgggccgtcgccaccggggcggcggagcgggccggctccctgcccgtcccggagtccttcgagaacgtcgccgggctcggcgtccggggcgtcgtcgacggacacgccgtcctggtgggccgcgagcggctgctggccgactggtccatcgagctgccggccgggctggccgaggccaaggcggccgccgaggccgcgggcggcaccgccgtcttggtggcctgggacggcgcggcgcgcggggtcctgaccgtggccgacgcggtcaaggagaccagcgccgaggcggtcgcccgactgcgggcgctgggcctgaccccggtcctgctgaccggcgacaacaaggccgtcgccgagacggtggcccgcgaggtgggcatcgacgaggtgatctccgaggtcctcccgcaggacaaggtggacgtcgtacgccgcctgcaggccgagggccgcacggtcgcgatggtcggcgacggcgtcaacgacgcggccgcactggcccaggccgacctggggctggccatgggcaccggcacggacgcggccatcgaggcgggcgacctgaccctggtacggggcgacctgcgggtcgcggcggacgcgatccggctctcgcgccggaccctggccacgatcaagggcaacctgttctgggccttcggctacaacgtggcggccctgccgctggcggccgccggcctgctcaacccgatgatcgcgggggccgcgatggccttctcctcggtcttcgtggtgaccaacagcctccggttgcggtccttccgctagtggccctcctccccacggtccgcacacttccttcacgggagacgcagatcacagtgaccgcaacgtaaccatccggggtcgtcatgggtctaatggggcgatgccaagaacgtcttgggggacgtttcacggagacctggggaggtttccgtgggtatcagccggccgggacacgtacccgcggggaggctttgagcggccctcccgaacgaaacgggtcccggcacaccgacgccccggctcgggtcccgtggggggaatccgtttcggggaaaagggaagcgccccgaccgtcgacccgtggggggatcgacggcggggcgcttctcgcatgctcagggttgcctgcggtgcgctccgcgcggccgcacgccgcgcggaggaaagcctcgggtcagcgggcttcgacgggaacgaagtcgcgcaggacctcgccggtgtagatctggcgcgggcgaccgatgcgggaacccggctccttgatcatctcgtgccactgggcgatccagccgggaaggcggccgagcgcgaagagcacggtgaacatctcggtggggaagcccatcgcccggtagatcagaccggtgtagaagtccacgttcgggtagaggttgcgctcgacgaagtagtcgtcggccagcgcgtgctcttccagcttgagcgcgatgtcgagcagctcgtcgctcttgccgagcgccgagaggacgtcgtgcgccgccgccttgatgatcttcgcccgggggtcgaagctcttgtagacacggtgtccgaagcccatgaggcggacgccgtcctccttgttcttcaccttgcggatgaaggcgtcgacgtcgccgccgtcgttcttgatgccttccagcatctccagaacggactggttggcgccaccgtgcagcggaccccacagggccgagatgccggcggagatcgaggcgaacatgttcgcctgcgaggagccgaccagacgcacggtggaggtggagcagttctgctcgtggtccgcgtgcaggatcagcagcttgtcgagcgcggagaccacgaccgggtccaggtcgtactcctgggccggcacggagaaggtcatgcgcaggaagttctcgacgtagccgaggtcgttgcgcgggtagaccaccgggtggccgaccgacttcttgtacgcgtaggccgcgatcgtcgggagcttggccagcagccggatcgtcgagaggttgcgctgcgtctcgtcgaacgggttgtggctgtcctggtagaacgtcgacagcgcgctgaccacggaggacagcatcgccatcgggtgcgcgtcacgcgggaagccgtcgtagaagcgcttcacgtcctcgtgcagcagcgtgtgctgggtgatctcgttgcggaacgacgcgagctggtcgacggtcggcagctcgccgttgatcagcaggtacgcgacctcgatgaaggtcgaacgctcggcgagctgctcgatcgggtagccgcggtaacgcaggatgccctgctcaccgtcgaggtaggtgatcgcggacttgtaggccgcggtgttgccgtacccactgtccaaggtgacgagcccggtctgggcccgcagcttcgagatgtcgaagccctggtcaccgacggtgctttcgaccaccgggtaggtgtattcaccgtccgcgtaccggagtactacagagttgtcgctcacgtcatccctcaccgacgtagtgcctcttcttcgaggtgccctgactgcctctaccttcccccatttggcgcaggagagtgcactcggggtcggcgtttggtgctttcgacggcactcagtgccgtcaagctactcatcctgccccctccacaccggtgccggaaccccaaatgatcgatcatctaggtgatgtttcccaccggtatccggccggacagcctggcagcgaccgccgtgtacctcctgcctgcggaaacggtacgcaccgcctggccgagggccttgcgggacccgacgaggacgaccagtttcttcgccctggtgaccgccgtgtagagcaagttccgctggagcatcatccaggccccggtggtgacggggatcaccaccgccggatattcactcccctgtgaacggtgaatggtgacggcgtacgcgtgcgccagctcgtcgagctcaccgaactcgtacacgatctcctcatcctcctccgtccgtaccgtcaggcgctgttcgtccacgtccaggccggtgaccacgccgaccgtgccgttgaagacgccgttggcgcccttctcgtagttgttccggatctgggtcaccttgtcgcccacccggaagacccggccgccgaacctcttctccggcaggttcggccgggccggtgtcatcgcctgctggagcagcccgttcaggttcccggcgccggccgggccccggtgcatcggggcgagcacctggacgtcccgccgcgggtcgagcccgaatctggccggaatccgccgggccgccacgtccacggccagcaccccggccgcctcggtgtcctcctccgggaagaggaagaagtccggcaggccgtccgtgatcggcggcaacccggtgttgatccggtgggcgttggtgaccacgccggactgctgggcctgccggaagatccgggtcaggcgcaccgcgggcaccgggccgccctcggccagcaggtcccgcagcacctccccggcgccgaccgacggcagctggtccacatcgccgaccagcagcaggtgcgcccccggcgccaccgccttgaccagcttgttggccagcagcaggtccagcatcgaggcctcgtcgaccacgaccaggtccgcgtccagcggccgctcccggtcgtacgccgcgtccccgcccggcttgagctccagcagccggtgcaccgtggaggcctcggccccggtgagctcggccagcctcttcgccgcccggccggtgggcgcggccagcaccaccttggccttcctcgcccgggccagctccacgatggagcgcacggtgaaggacttgccgcagcccggcccgcccgtgaggacggcgacccggcgggtcagcgccagcttgaccgcgtcccgctgctcgggggcgagcgtggcccccgtccgcccggcgagccagcccagggccttgtcccagtccacgtcctggaaccccggcatccggtcgtcctcggcgtgcagcagccggcgtacctgccccaccagggacagctcggcccggtggaagggcaccaggtacacggcggtcagcgggtcgggcccgccctgcggatccggtacgggctcccgtacgaccccttccgggtcggcggcgagctcggccaggcagtcgatcaccagccccgtgtccacctggagcagcttgaccccgtcggcgatgagccggtcctcgggcaggaagcagtgcccctggtcggtggactgggacagggcgtactggagtccggccttcacccgctcggggctgtcgtgcgggatgccgacggcctgcgcgatgcggtcggcggtgaggaagccgatgccccacacgtcggcggcgagccggtagggctggttcttcaccacggagatggaggcgtcggcgtacttcttgtagatgcgcacggcgatggaggtggagacgccgacgccctgcaggaagaccatcacctccttgatggccttctgctcctcccaggcggcgccgatcagcttcgtccgcttggggccgagcccgggtacctcgatcagccgcttcggctcggcctcgatcacgtcgagggtgtcggtgccgaagtgctccacgatccggtcggcgatcttcgggccgatgcccttgatcaggccggagccgaggtagcggcggatgccctggatggtcgccgggagcacggtccggtagttctccacggtgaactgcttgccgtactgcgggtgggagccccagcggccctccatgcgcagggactcgccgggctgcgcgcccagcagcgcgccgaccaccgtcagcaggtcgccgctgccgcggccggtgtccacacgggcgaccgtgtacccgctttcctcgttggcgtaggtgatgcgttcgagcacgccgtcgaccaccgccagttgcaccgcccgcggcgccccctctgctgctgccatgccccgaaactaccgggcggcgccgacagtgcgccggtcctgtggacaacgcaaagggggtcccgcctctcggccggaccccctcacggttacccctcccgtgccggacttcccgatccccccagatccctccccggaagcaccgacgcaccatacgacccgcgatgcgcccgcagggttgcatccggaaccacagctttgcgtttccgttaccaaacgcctactcaaggtgccggtgaatcggcacagaagtagcgtttccggcatgagcgaatcttcattccaggacgacgtgctgggcgaactgggcgacgaccggctgaccgagatcgcgggcctgctcggcacggacacctccggcgcccgggagaccgtcgcggagacgctcggcgtcatggccggcgacctcacccagcgggtcgacgcggacgacgccgacggcgcggaggcgcgccaggccctcgccgaggtggccgaggccgagccgccgctggagggcgtcgccaccttcggcggcctcggcggcctgctcagcggcggaatgatggccggggtgctggccaaggtgagcaagccagtggccgccgccgtctcgaagcggaccggcatccccgcggccacgatcagccgggtcatcgagatgctgatcccggtcatcctggcggtcctcgccaggcgcgcctccggcagggccccgggcggccggtcggccggcgcgccctccgcgggcgcccccggcgctcccggggcggcccccgccgcgggcggcggcctcggcgacctgctcggcgagatcctcggcggtggcaagaagtagacggcgggaaatggccacttcggggcccccgcaccacagcctccccctagagttgccccatggctgagagcgtgcggctgcgcgacccggaaccgggggacctgggctggatcgtgcagcgccacggcgcgctgtacgccgccgagtacggctggaacagcgacttcgagggcctggtcgcccggatcgtcgcggacttcgcccaggaccacgacccccacctcgaacgcgtgtggatcgccgagctggacggccggcccgtcggctcggtgatgtgcgtacgggaggagggcgcgcccggcaccgcccggctgcggctgctcctggtcgacccgcagggccgcggccacggcgtcggcaccctgctggtcgacaccgtcgtggccttcgcccgctcggtcggctaccgcgagctggtgctgtggaccaacgacgtcctggccgacgcccgcgcgctctacctgaaggccgggttcaccctgatcgcggagcggccgcaccgctcgtacggggtgagcctgacgggacaggactggcggctgccgctgcgggagggctccccgcgctgacgcccgaaccgacccccgtacggttcacggcgcgcgcgggggccagcgaggtgagcgccactccgcccaccagcagtacggccgccagccagcgcagccccgagacggactccccgaggaccagggccgcggaggacatcccgaagaccgggaccagcagcgagaacggggccaccgcggaggccgggtagcggcgcagcaggtagctccaggcggcgaagccgaagacggtggacacccaggccacgtagccgatgacggcggccccggaccagtccagggcccgcagcgcggccaggtcccgctcgggcccctccagcaggagcgagagcgcgagcagcggcaggaccgggaccgtgcacacccacaccatgaagttcagggcgtcgggcggggcggccttgcgggtcaggacgttggacacgccccagcaggcggcggccgccacgaccagcgtgaagccgagcaccggccccgaggttccgccgtccaccgcggcgaccgcgatcccggcgagcgcgacggccatccccagcacccggacccggccgggccgctcgcgcagtacgacggcggccaggacggcggtgaagacggactggatctggaggaccagcgaggacagcccggccggcatgccggcgtccatgccggtgaagagcaggccgaacttggcgacgccgagggcgatcccgacaccgatgatccacttccaggcggccttgggccgcccgacgaagaacacggcgggcagggcggcgacgaggaagcgcagggcggacaggagcaggggcgggaagtggtcgaggccgatctcgatgaccacgaagttgaagccccagacggctgcgacgagcacggcgagggcggtgtgaacggggcgcatgctgtgagcatcgaccaccggaccatgtagcaccagctcggatgtcttccgggatggatgaagcgttgcttacgcatacccgcggtgccaccatggagacatgctcgatctcgcccggctgcgcgccctgcacgccgtctccgtccacggctcggtcgccggcgcggcggccgccctcggctacaccccctcggcggtctcccagcagatctccaagctggaacgggagacccgcaccaccctgctggagcggcgcgggcgcggggtcgcgctcactgaggaggctcgccatctggccgaagccgcccaggagttgctcgcgatcgtggagcgcaccgagaccaccctggaggagcggcgcgggcagcccggcgggctgctgacggtggctgccttcgcctcggcggcgcgcgggctgctaccgcaggtactggccgatctggcccgccggcatccggcgctggacgtccggctcacggaggtggacccgcacctgtccgtggagctggtggcccggggcgtcaccgacctggcggtggcccacgactgggacatcgccccgctgcccgcgcccgagggcatcgagcaggcggtgatcggggacgacctctgcgacctggtcgtgccggccgggcatcccttcaccacgcgccgggccatccggcgctccgacctcggaggcgagcgctgggtctgccagccgcccggccgggtctgccacgactggctggtacgcaccctgcgcaccgccgggttcgagcccgacatcgcgcatgtcgccgaggagaaccacaccatcgtcgccctggtggcggccgggctcggggtggccgtcgtaccacggctgggcaccggcgcgctgccgccgggggccgtggccgtgccgctggagccgggccccgtacgccggttgtacgccctgtggcggaccggggccgcccggcgtcccgcgatcaccgaggccgtgcggagcctccaggagcactgggcctaggtgtgttgtcgatcaggccgagcccggcctgatcgacaacacatcccctgaacggcctggtcccggcactgagctgacgccgcccgaaacccccgtcctcgggcggcgtcagctcagtgccgggcccgcgagaggcccccggtcgtcggcgggggctccggtttcccggcccctcaccgacccttcggcgcccactctgccaagccccggagcaccgcgcattggcctggcgtgcacagtgtcttgacggagagtcgccccgccgcccgcgccccggggccggcacttgttgcgcgggccgcgacggccggtgtaaacccgtgatcatgctgcccgagagaacgttccgcagcgcggaactagcgcccgccgaccgtttcgagagctggcgggctctgatgtcggagacgcatgcgcccatggagatgcgcagtgagtacgccgccgacttctgggtgaaccagcgcgtcctctcgctcggcgggatcgcggtctatccgatggaatgccgtcccctgaccttcaagcgcacaccgaagctgatagcgaggtcggaccccgaggcgttccacctctcgctgatcaaacgcggggcgggagcggtgacgctgggcaaggacaccgtggtgcacggtgtgttcgacatccacaccagtgacacgtcgcggccgttcgagatcagttccggcccgcattccgtcgagatcatcggggtcgaggtccccaaggcgctgctgccgctgcccccgcacaccgccggccgggtcatcggaaggcgcatctcggcccgggagggaatgggggccctgctggccaccttcctcggccaggtgaccaaggacagccggtcctaccggccggccgagggcccgcgcctgagcggcgtactggccgatctcgtcgcctcgctcttcgccggcgtcctcgaagcggaccggtccttgaccccggagacgcaccggcgcgccctggcgctccgcgtgaaggccttcatccgggacaacgccgacgatccgctgctggacgtccccgcgatcgccgccgcccaccacatctccgtcagctatctccaccgggtgttccagcaggagggggacggggtcacggtcgcggccttccttcagggccggcggctcgcgggggcacgccaggacctggcggacccgctgcaccaggaggtgcccgtgcacgtcatcggcgcccggcggggcttccggcacgcgtccgcgttcagccgggcgttccgcgaggcctacggcctgccgcccgcggccttccgcgggcaggcccgggcggaagacctggccggggcggacgcctaggcccccggaggggcgacacgcagcgacacgcccggcccggcgcgaacagcaccggtagggtccggcgcgtgtcgtaccacgcctcgcgccggaatctgctcgccgcggccgccatggtcgccgtcacggccgccggggcggcttccgccgcggtggacccccaccacgtccccgacgacgcacggccccccgggcgccgtcccggccggggcgcgctgcgcgccctcctggaccggatgagcctcgacgagaagatcgggcagctcttcgtctcacgggcctacgggcattcggcgaccgaccccgatccggcggacgccgagcagaacctggcggcgttcggggtgcgcaccgccgccgaggtggtctcccgccaccacctcggcgggatcatctacttcgcctgggcccacaacacccgagcccctcagcagatcgccgcgctctcggtcggtctccagcaggccgccctcaccaccggtgcccggatccccctgctgctctccaccgaccaggagcacggcgccgtcgcccggatcggcaagcccgcgaccctgctcccgggggcgatggccctcggtgcggccggctccaccgcccacgcccggcgggcggcccgcatcgcgggctccgaactggccgccctggggatccggcaggactacgcgccggtggccgacgtgaacgtcaacccggccaatccggtgatcggcgtacggtccttcggctcggacccgcgggccgtggcggagctggtggccgcccaggtccgcggctaccagggggccggggtcgcggccaccgccaagcacttccccggccacggggacaccgagaccgacagccatgtcgggctgccggtgatgcggcacacccgggccgcctgggaggagctggacgagccgccgttccgggccgcggtggaggcgggcgtggacgccatcatgacggcgcacatcgtcttccccgcgctcgatccctcgggggacccggcgaccctctcccggccgatcgtcaccgggctgctgcgcgaacgcctcggcttcacgggtgtggtggtcaccgacgccctggacatggccggggtccgccagaagtacggggacgaccgcgtgcccgtcctggccctgctggccggctgcgaccagttgctgaacgcgccggacctggcgctcgcgcagcgcagcgtgcgggcggccgtcgagtcgggcgagctgacggaggcgcgcatcgaggaatcggtactgcggatcctggaactgaagacccgccgggggctgttcgacgaggcgtacaccacgggccgggacgtggacgccgtggtgggcgcgcaggagcatctcgacgccgccgacgcgatcgcgggcgccacgacgaccctgctggccgatccccgcgggctggtgccgttcgatgcgacggccgggccacgtctgctggtcaccggggccgacccggcctcccccacgggtaccaccgggccccctacggccgtactggcccgggagctgaccgccctgggctgccgggccacggcggtgccgcccgcccgcgccgtggccgccgcgccgggtcacgcggcggtgctggtgtgcacgtacaacgtcccggagggcgagagtccgcagcgcacgctggtggcggacctgatcgcgtccggcgtcccggtcgtcacgctggcggtccgcaacccgtacgacccggcccggctgccggcctgtgcggcggagctggcgacgtactcctggacggacgtggagatgcgggcggcggcccgggtgctcaccggggcgctgcggcccgccggccggctccccgtgcccgtcccgggccgctacccgctgggccacgggctgacgcgctgatccctcaggcgccggcccgcggcccgcgtgtcccggctccggactccggactccgggctccgggttcggagctccggcttcccgttacggccgcagctgcggctcgcgctccaggtcgcgctggtcgagctgcgcgtcgggcgccgccagcggcgccgccttccccgcgtcggcgagcgcggcggccggggccaccccggcccactggaggatcttcgaggtggcgaggttcttctcgccctccatcagcttggagacgctcgccccgtggttggcacccggcgcgatcatgacgtagctgtcgcgcaccccgtagccgaggcggaacggttcggcgccccacgggtcgttctgcccgtacacgaacagcatctggttcgcgttgccgcgcacccacttgtccacgtccgccatcacccccggctggaaggtcatggggatgtcgcggggcacgaagttgcgcggcggctggtagccgtagcggctcagacccttcaggtgcggcagcttgatgtccggggaaccgagctgcgtacccgcctggtagtagtacggcgtgtacgtctgcagtccctggtcggcgtacgccgagaagccggagatcgcgtcgaccgagtcccagatctgctggtcgctcgcggtggcggcgtccgggatcgaggcgcagtcggcgagcaggctgtactgccagaaggcccatacgtagtcgagcacgacggcctcgtaggccttgtcgaggtcgccgacggtggtgaaggtccagccgttctcggcggcggcgaccgcgtacttggcctccaggggctcccggcgcaccagcgcctcgcgctggaccgcgttcagcttgtcgcggcactccttggtgccgaccttggcgaagaaccggtcgtaggctgagtcctcgttgttgacgacgtcgttgggcgcgacgtacgcgacgacgccgtccatgtcgcgggggtagaagcgctcgtagtacgtcgccgtcatgccgcccttgctggcgcccgtggccagccagttcttcttgtagatcttcttcagcgcggtgaacaggcggtgctggtcactggcggcctgccagatgtccaggttcgaccaggtggcggggtcgggccgggagggtgtgaagaatcgatactccagtgacacctggttgccgtcgacgatggtcgtcggctcgctgcggcgcgggctggtgctgacgttgtagccggaggtgaagaacaccgacggccgcgagacgtccttgtgcagcagggtcaggcgctgcttgaaggtgcccttccacggctgccggtggtccaccggctgctcgtagttcagtacgaagaagcggtagccggtgtacggcttctcctcgatcaggctcatcccgggaatgccgaggatctggtccttgatgtccgtggcggccgcgggctgcgcggcggtggccgcttgcgccgtgaagccggccgcgcccatggtgccgatgagcaccacgagcgacagcagccatccgagcgtcttgcgcattcaccctccccttgagttcacttcggtcgccgtgaacctagccgggtcaacgcaccactgaccagacctagttgggcctgtccgtcagcacaggatccagccggagtccacagatccggcccccacgctcccctttacatacacgcagcggttgatcgcgcccacggtgacgggaccggcgtaccgggtgaatctcccggcctcgcgcaccggggccccgccgcgcggctggatgctcaccgccatccggcgccgctcgccggagacccgcgccacggtcatggcgcaggcctggttgcggctcttgtagacccgcacctcacccgtctcgaacgccaccgtccgggccagccggcccccgcagccctcggtcgcggcctgcgccgccggcggcgtgaacagcccgcccgcacacagccacagcgccgccgtgaaaacccccagggacgcaaccctgcggccgcgcctcctccatgcctgcaacaccctgtcccccgatcggccatacgtacagcgcacgcacgcacgtacgacgcccgaaccacccggatggttgccgggcgcaagggagcggcgaccgacaccggccaccctccctcgtacgggtgcatccgccacctcccggtggaacagcgggagttcacacccgggcaggcgattacgctaggtgacccataccccgctcgccgtgaccgcagccgtggctgcagccgtgaaaggccatgagatgacgaacgacctgctggaccgcaagctggcgcgcaccttcacgcacctggacgccgaccggagcggcgtgatcgacgccgacgacatcatcgcgctcggctcccggctgctgacggccctcgccgagccggccggctcccccaaggcggagctggtgatgggcgggctggccgatttctggcaggacctgttcaccgagctggacatcgaccgggacggcaaggtcacgcccgaggagtacaagcagggcatgacccgcctgtacgcgcagggcgggcccgcctacgaccgctcgttccggccgatgatgcgggcgatcctgacgatcgtcgacaccgacggcgacgggttcatcagcccgcaggagttccaccgggcgcaggaggccttcgacacgcggctgagccccgccgacaccgaggcgctcttccggcgcatcgacgccaacggcgacggctgcctcaccgtcgacgaactgctcgacgcggtacgcgagtactacaccggcaccgacgaggacgccccggggaacctgctgttcggcgagttctgatcccgggacgtcccctgagggtgtgtccgctcaggccgccgcgcgctcgtcctcgccgacgaaggtgcgccacagctcggcgtaccggcctccgcgcgcgaggagttcggtgtgggtgccgtcctccacgacccggccccggtccatgaccacgacccggtcggcgcgcgccgcggtcgtcagccggtgcgcgaccaccagggtggtgcgcttgcccgcgagccggtccgtcgcctggttgacctgcgcctcggtcgccaggtcgagggcggcggtggcctcgtcgagcagcagcacgtccgggtcgacgagctcggcccgggccagtgcgatcagctggcgctggcccgcggagaggttgcggccgcgttcggcgacggtgtgcaggtagccgccgtcgagggtggcgaccatgtcgtgggcgccgaccgcgcgggcggcggcctccacctcggcgtcgctcgcaccggggcgcccgtaggcgatggcgtcacggatcgtccccgggaagaggtaggcctcctgggggacgacgcccagccggtggcggtacgccgtcaggtccagctcccgcaggtcggtgccgtcggcggtgacccggccggaggtcggatcgtagaaccgggccaccatcttgacgagcgtggacttcccggccccggtctcgccgacgaaggcgacggtctgccctgcgggtatccgcaggctgataccggccagggcttcgcccttctcgccccgttcctcggccgtcccgtactggaagcggacgtcctcgaaggcgatctccccgcccagggtccgcagggcgcgcggccgctcgggcagcggggtggtggtgggctcgcgcagcagcccctggatccggccgagggagacggtggcctgctggtagccgtcgaagacctgggagagctgctggacgggcgcgaagaacaggtcgatgtagagcaggtacgcgaccagcgcaccggtggtgagcgtcccggcctccacccggcccgcgccgacgatcagcacggcggccgcggcgcccgaggacagcagctgcacgaaggggaagtagacggatatcagccactggccgcggacccgggcctcacggtaggagtggctgcgctcggcgaaccgcttggcgcccgagccctcgcggcggaaggcctggacgatgcgcaggcccgagacggactcctggaggtcggcgttgaccaggctgacccggtcgcgggcgagctcgtaggcggccacggacctgcggcggaacacgatcgtgccgacgaccaggacgggcagggtcgcgaacacgatcagcgcgagctcgacgtcgaggacgagcagcgcgatcaggatgccgaagaaggtgaagacggagaccacggcggtgacgagcccggtctgcaggaacgagctcagcgagtccacgtcggtggtcatccgggtcatgatcttgccggtcagctcgcgctcgtagtagtcgaggccgagtcgctggagctgggcgaagatcttgacgcgcagggcgtacagcacgcgctcgccggtgcggcccgtcatacgggtctcggcgaactgtgcggcccactgcgcgacgacgacggccagggcgagcccggcggccacccagacggcgccgaggacggcctgttccacgccctggtcgatgccgtgccggatcaggatcggcagcagcagtccggcacccgcgtcggcggcgacgaggccgaggctgatggcgagcggtgcccagaagccgtggagcagtcggcgcagaccgtagctctcctcggcggccgcggcgcgggtctcgtccacctcgggcaggtcttcggcgggcggcagcgccgccacctgcgcgagcagttcgggggtggcgggcatgccggcgacggacccggccatggggtgcccggctccgggcgcgccgcccgcggcggcgggggccgtgggggtggagcccgtgggggtggggcccgtggaggtggagcccgtgggggtggagtccgtgccgtcgggctcgtcctggcggcgccagagctcgggggtgaccccgcccgcgacccggcgcttggcgttgacgggctccgagtcgatctcggcctccagctcgatgccgcgttcgaggtcccggtcgagctcgcgctcgaactcggtcatcacccgggcgtccggggtgcgcggcgaggcggcgccgagcgcgtccgggtcggtgagcagcctgcggtagagcgcggagcggctctccagctgctcgtgcgtcccgatgtcggcgagccgcccgcggtcgagtacggcgatccggtcggccagcgcgagcgtggagcggcggtgcgcgatcagcagggtggtccggcccgccatcacggagcgcagggcctcgtggatctcgtgctcgacgcgggcgtcgacggcggaggtggcgtcgtcgaggagcagcagccgggggtcggtgaggatggcgcgggcgagggcgatgcgctggcgctggccgccggacagggtgagcccctgttcgccgaccttcgtgtcgtacccggcgggcagggcccggatgaacccctcggcctgggcggcacgggccgcggcctcgatctgctcctcggtggcttcggggtgcccgtaggcgatgttggcgcggatggtgtcggagaagaggaaggagtcctcggggaccaggccgatcgcgccgcgcagggagtcgtaggtcagctcgcggacgtcgtggccgccgacgcggacggcgccgccgtccgcgtcgtagaaccggggcagcaggagcgcgacggtggacttgccgctgccggaggagccgacgacggcgatggtctcgccctccgcgacggtgagcgagaacccgtcgaggaccggccgttcggggtcgtagccgaagcggacgtcgtcgaactcgacggtggcgggcgcgtcggcgggcagttcgcgggtgccctcgtggatctcgggctcggtgtcgatgagctcgaacacgcgctccacgccggcccgggcctgctggccgacggtgaggaccatcgcgagcatgcggacgggtccgacgagctgggcgaggtaggtggagaaggcgacgaaggtgccgagggtgacctggccgttggtggccatccagccgccgagggccagcatggcgacctgggcgagcgcggggacggcctggagggcgggggtgtagcgcgagttgagccggatggtccgcatccgcccggcgaacagccggcggcctgcttcgcgcagcttgccggtctcctgctcctcctggccgaagcccttgacgacgcggacgccggtcacggccccgtcgacgacggtggcgacggcggcggcctggccctgcgcccaccaggtggcggggaagagcttcttgcggctgcgcttggcgatgaaccacagggcgggtgccatgagcagggcgaccagggtcagcagcggcgagagccagagcatgatcccgagggacatcccgaagagcaggaagttcccgatcgtcatgggcagcatgaagagcaggccctggatcagctggaggtcgctggtggcgcggccgacgacctggccggtgttcagctcgtcctgtcgccgcccgtcgaggtgggcgatcgtggcgtacatgtcggtgcgcaggtcgtgctgcacgtcgagggcgagccgcccgccgtagtacctgcgtatgtaggtcagcacgtacacgagcagggccgcggctatgagtaccccggcccaggggcccatgggcttggtccggtccccgatgacgtcgtcgatgatcaccttggtgaccagcggcacgaccgccatgacggccatgccggccagcgaggagccgagcgcgagcagcacattggtcctgtaccgccaggtgtagcccgccagccgcctgccccagccctgtttctccccagccgctgtctctgccgccgccacgtgaggcctccccgttcgtcctgtcctgccggaagcgccaacgctccgaccggcggatttcatcccgccgcaacaatcgcactgccgtgcggcgggggcgcgcggaacgggtccgaccgggggcgggaggcggggtcgggacctgtcaagtcacgactttccggatctgtgacggacggagtgcactgccgatgctggaagtcggccgccccccgatcgcggtggcgcagcgaagggatcgaggaccatgtccactcaccaccatcacccggccggcgccgtcaccggcttcatgcagcggaccgtccgcgccgtcgtcccctacgtcaccgcgttcctcatcgcgctgctcgcggcgaagatcgtcgggctgctgaccgagaacccgtgggcccggctgggaacggcgctgggcgtggccgtggtcagcctcctcctccacacctacgaggagccggaaggccgtcctcgcgactgacggccgatgaccgcgggccggccggcccgctcgtccccctcagacgtgcgtcggcgcgaacatcttcagggtcgccgcaaggaccaggaccgaggggcccggggtcgccagtgcctttctcaggtcggcggtcagggtctccggggtggtggtcgaggccgggacgccgaaggaccgcgccagggccacgaagtcggggccggccagctcggtgcccgtcccgcagccgtactcgcgcaggatgccgtagccgccgtcgtccacgatcagccaggtgacgtcgaggtcgtgctgcttcgccgtggccaggtccgcgaccgagtacatcgcgccgccgtcgccggacaccgccagcaccggggtgtccggttccgccacgcacgcgccgagcgccgccgggaaggcgtagccgaggccgcccgcaccctgggccgagtgcatggtgttggggtgcttggggtcgaaggcggaccaggcccagtaggacaggatcgtcatgtcccagaaggacggggaacgggcggggagagccgcccggatcgagccgagcagttcctgttccagggccacgtcctgggtggcgaggcgggccgcgatgtccgccagcacggcgcggacgcgttcgggggcgccggcgtcctcgcgctcggccaccgtctccagcagggcctgcagcgccaggcgggcgtccgcgtggatgcccaggccggcgtggttcgactccagcttcccgaggtccgcctcgatctggacgacccggcccgtcgggaagaacgtgtggtagttcgacgagagctcaccgaggcccgagccgaccaccagaaggacgtccgcgtcctccaggaagtccgtcatgtgccggtcctccagccaggactggagggagagcggatgggtccacgggaaggcgcccttgccgccgaaggtggtgacgacgggcgcgttcaggcgctccgcgagctgcttgagcttgcccgccgcgtcggagcggacgacaccgccgcccgcgatgatcaccgggcgggtggcgttctccagccagtgggcggccagggccgtcagctcgggccgcggcgcgagctcgtgcggggtcgcgtccacgcccgtgacctgcggaatgacggtctcggcccgcagtacgtcctcggggatctcgacgaacaccgggccgtgcggggcggtcagggccgactcccaggcctcggcgatcaccgaggggatctgggagggggtgcggaccgtgtggacggacttcaccacgtcccggaaggacgccgactggtcccgcagctcgtgcaggtgcccgcgccgcccgccgcccaggcccgccaccggcacctgggaggagagcgcgaggaccggggcggaggcggccgccgcctccgccagggcgggcagcgccatcagcgcgccggggccggtggagagcagcaggggcaccgcctcgcccgtgatccggccgtacgcgtcggccgcgaagcccgcgttgttctccgtacgcagccccacgaggcgcaggtcggagcggccgaccgcgtcgaagagggcgagcgcgtgctggccgggcaggccgaaaacggtgttcgcgccgagcgagcgcagcgtttccacgaccaggtccccgcccgtccgccccggcggcggcgcgagcgcggccgccttctgggcttcggtgggacggagtaccaggtcgtggtcgtgcgtcacttcgcttacttgcccttcgcctgcgcgatctgtcgcgacatgatcgtggtcagctcgtacgcggtgtgcgaggccgcgaccgaggtgatctcggcgtgatcgtacgccggggcgacctcgacgacgtcggcggaaacgaggttgcaggaggacagaccgcggatgatctccagcagctcgcgggaggtcatgccgcccgcctccggggtgccggtgccgggcgcgtgcgccgggtcgagcacgtcgatgtcgatggagatgtacagcggccggtcgccgatgcgctggcgcagctggtcggcgacctcgtcggcgccgcggcggtagacgtcggcggaggtcacgatgccgaagcccatcttggcgtcgtcgtcgaggtcctgcttgccgtacagcgggccgcgcgtgccgacgtgcgagagcgcctcggtgtcgaggatgccctcctcgacggcgcggcggaacggagtgccgtgggtgtactcggcgccgaagtaggtgtcccaggtgtccaggtgcgcgtcgaagtggagcagcgcgaccgggccgtgcttcttcgcgacggagcggagcagcgggagggcgatggtgtggtcgccgcccagggtcatcaggcgggagccggaggagagcagctcgtcggcggcggcctcgaccgtctcgacggcctcgttgatgttgaaggggttcacggcgatgtcaccggcgtcggcgacctgcgcgagcgcgaacggggaggcgtcctgggccgggttgtacgggcgcagcaggcgggaggcctcgcggatggcgttgccgccgaagcgggcgccggggcggtaggacacgccggagtcgaagggcacgccgacgacggcgacgtcggcggagccgacctcgtcgaggcggggcagacgggcgaaggtcgccgggcccgcgtagcgcgggatacgggaggagtcgacggggccgcgcggctgcgtgctcatggctgtgcctctttctctggcctgacgtgtgcggtacttcgagcgtaagcgggccacccgggggtggggagtgtacgtttcatccatccggcagtgttgaaatgtatggagtatccatgcccgcccctcccgctgcgcctcgcgatccggagtacggcatcggccccgccggggagccgctcaccccgccggtgctcctcaccgcgctgctcggggaccgggagctcggcctgcgccacctcgccgggccggccaccgccggggtgcacggggtgcacgcctccgagatgcccgacccctccccgtacctgctcggcggcgagctgctgctgaccgccggggcgggccccgccgacgaccccgacgggtacgtggcccggctggccggcgcgggggcggccgcgctcggcttcggcgtggccccggtgcacgaggaggtcccggccgcgctggccgacgcctgcgcccggcacgggctgccgctgctggaggtcccgccgcggacccccttctcggcggtcgcccgcgcggtggggcggctgatggcggaggcccggacccgggagctgcgccgggtcaccgaggcccagcaggccctggcggcggccgcggcccggcccgacccggtcccggcggtgctggccaggctcgcggccagcctgggcgggtcggtcgccctgtggccgggcggccgggcggcgggcccggagctccctgctccggcctgggaggccctgtccgcgctgctggcccgggtcggccgcgagggcgggcccgccacggccaccgaccgggcgggcggacaccacctggccgcctacgccctggccgggcgggcggcgctgggcacggcgaccccggcccgcgccccgggcgaccacaccgtggcatcggtggccgccgtgctgctgaccctgctcacggccgagcggccggccggggccgaggcggcggccctgacccggctgctgctcgacgggaatccggccggggccctgacggccggcccctggtacgccgtccacgcccgcgggtcgggggatccgcgggccctggcggccgccctgggcaccgtactgctggacccgcacgaggacggcgtacggctgctcaccgaccgggagcccgaggcgcagcccggctggcggctcggggtgagcgccccggccgcgcccgccgggctggccacggcggacgcccaggccgggcgggcgctggagcgcgcggaggcgacccgtaccgcgctggcccgccacaccgaccccggcctcgcgggcctggtcggcgaggccgaggcccgcgcccatgcggaggccctgctggggccgctctcccccgctctgcgggagaccctgcgcggctggctggcccaccacggcaactgggaccgcacggcggccgccctcggcgtccaccgcaacaccgtccgccagcgcgtcggccgcgccgccgaactgctggaccgggacctggacgacccggacgtccggatggagctgtggttcgcgctgcgcgtcaccgcggggtgaggccggagccgggacgggtgcgggcggggcccgacgggtgagggccggccccggccccgcgctcacccgcgccggccccggcccccggctcacccgcgccgcgccggccccggcctcccggctcacccgcggtggccgtccggcgggcggaaggcggagagcagctccacgaagcgcgcggagcccgtgatcacacccggctcgtcactgccgggcggcgcgggctccaccccgaccgactcgatcccgtcctcccctatccacagcaggcgcgagctcagccggtactcctcgggggcgtcctcccacatcttccgcaccagcggcccgtaggcgatcacgcaggtgtgcagctccggcccttccacggcccacagcatcaggtggccgtggaaggggaccatcgcgaggatgccgtgcggcgccgggcggtcgacgaggtcggcggcgcgcagcaggtgggtcgaggtgtagccgccctcgccctcgacgttcaccagcgggttctcgtcctcgttgtactggagggagaccggtgcggcctccaggttggccatggcggcggcccacacctcggcctcgtccacgcgccaggagcggaactggtccggcgggacgggggcggagaggtctccgcccacgtggatcacgacgacgacggcgagttccccggtcagcgccacggacagcccgtggccctcgccgaccgcgtcgaccgtcaccagcctcggcatgagcaggttgcggacctcggcgaagcccgcccgctccagctcgcgccggcggtcggcgagccgctgcttctggttcaggaaggagaccgtggccgaccgccagttcgcgtgcggcagcgcgcggaccagctcggctatctccgcgaggtccagcggtgcgccgggctcgccctcggcggcgagcgagaggtggcgctgctccccgaagcgcatgggcggcccgctcttgttcccgtccaggaagacgtcgttcaggagcgcctcgaaggcgtgccagtcggcggggccgaaccatgcgcaccagggcggtaccggcgacgcccccgaccctccgcccgcatccgggccggccttcttcgctctccggaaaagtggcatgccgggcaggctaggggagggcgaatcggtacgtgagaccacgaacaaggcattcttgagcacattccggccaccacggcacggatgaaccccctctgccggagccccgggcggcgggcccggggtgagccaccccaccctttctcgggcgctccgactctggacagccagattgactggccggtaacttatcctgagcaagcgcttaggcatggcggcggaccgccgcgaccgaagggagccggctgtgcgccgtaccgttttcaacgaggaccacgaggcattccgcgagaccatccgcgccttcatcgaggccgaggtcgtcccggtctacgacgagtggttcgcagccggtcaggcgccgcgcgacttctactacaagctcggcgagctgggcgtcttcggcatcaacgtgcccgaggagttcggcggcgcgggcctggacacccacaagttcgaggccgtcctctacgaagagacctcgcgcgcgggcgtcaacttcggcggctccggcgtgcacgtgctgctcgccctcccctacatcaagatgctggccgacaccgagcagaagaagcgcttcctgccgaagttcgtctccggcgaggagatgtgggctctggcgatgaccgagccgggcaccggctccgacgtcgcgggcatgaagaccaccgccaagctctccgaggacggcacgcactacgtcctcaacggctccaagaccttcatcaccggtggcgtccacgccgaccgcgtgatcgtctgcgcccgtacctccgccccgtcggccgaggaccgccgcttcggcatctccctcttcgccgtggacaccaagtccgagggctactccatcggccgcaagctcgacaagctgggcctgaagacctccgacaccgccgagctggcgttcgtcgacgtcaaggtcccggtcgaggacctgatgggcgaggagggcaagggcttctactacctcggccacaacctggcctccgagcgctggggcatcgccttcggcgcgtacgcccaggccgccgcggccgtccggttcgcccagcagtacgtcacggagcgcaccgtcttcggcaagcccgtcgcgcacttccagaacaccaagttcgaactggccgcctgccaggccgaggtggacgccgcgcaggccgtcgccgaccgcgccctggaggccctggacgccggcgagctgaccccggccgaggccgcctccgccaagctgttctgcaccgaggtcgcgcaccgcgtcatcgaccgctgcctccagctgcacggcggctacggctacatgaacgagtacccgatcgcccgcctgtacgccgacaaccgcgtcaaccgcatctacggcggcaccagcgagatcatgaagtccatcatcgccaagtccatgggcctgtagggaatccgggcacctacccttcccccatgaacgacgcactgacgacgctcctcgatctgctcgacctcgagcagatcgaggagaacatcttccgcggtaccagccggccttcgctggtaccgcgcgtcttcggcggccaggtcgcggcccaggccctggtcgcggccggccggaccgtccccgcggaccgcaccgcgcactcgctgcactcctacttcctgcgcaccggggacacctccgcgcccatcgtctactcggtggaccggatccgcgacgggcgctccttcaccacgcgccgggtcgtcgccgtccagcacggccagccgatcttccacctctccgcgtccttccagaagtacgaggacggcctcgaccaccaggtcgccatgccgtccgccccggacccggagtccctgcccaccgcggccgagtcgctgcccgcgtaccgcgagatcttccgcgaccccggcacggtggagcggctgatcgagacccgcgaggcggtggacctgcgctacgccacgaccccgccctggggcagcgtcggcgagccggtggagccgcgctcgcaggtgtggttccgtacggccggcaagctcgacagcgacgatccgctgctgcacacctgcctggccacctacgtctccgacatgaccctgctggactcggtgctgctcgcgcacggccggggcggctgggcggtgggcgacgtggtcggcgcctcgctggaccacgcgatgtggttccaccggccgttccgcgcggacgagtggctgctgtacgaccaggagtcgccctcggcggccgcgggccggggcctgggccaggcccgcatctggacgcaggacggccggctggccgtgacggtcatccaggagggtgtcgtacgcgtcccgcgtgcgtgacccgcgcccgtctcagtcccaccagaacccccagtggttgctgccggtgaccgcctcgtcggcgtaggcgcggatgctgccggagccctgccagatgttgtcgggcgagaaggcgaagtgctccgcggcgacggggagcgcgtgggcggtcgtacgcggcggggccgccacggacacatggagctcgtcgaagccgagggcgacgacgcgggccccgaagcggtcctcccaggagcgcaggaccgtgctgatgagggcggtgtcgttctcgtggttggccggcccgccccagcccatcacggtcggtacgtcggccccgcggcccgcggggaccagggcgagccggggactcggcagggcgccgctcgctatcagctcgtccgcgagcccacaggccacggcgtccggatcgtccggggcctgcggcccgccctccgcgagcccgggccagtcccggccgaagggagcgatgagctcctccccctccgcaccctcctcggggtcgggcaccaccgcgctccagaactcccgcagcaccggctcgacgtggtggtcgtcggggtcggacatccgctccggccggaactcccgctcctgccaccaccgttcgagcccccgccggtcctggaacagcacggcctgcagcccggcggcggcgagcgccggactccggtgagcggcgagcgccccgacccccacggcctcgtcggacacccacaacaacggctcggacgccttgccccaccgccgccgtccgggcgcatccacgagcacccccgagggcaactccagccccagggaccgcccttgaggatcgtcggccagcacggacaacgggctgcgcgccttcgaagacttcgacatgaaccgaccgtaaccaccgccactgacaacgggtcaccccccggaagtgtgcgcgagtgggcgatgatcggcacgaccggctccgcaccgctccggcagatccggagcgacgggccatccatacatccaccccgaggcgatcattgaaacgactcctacggcactccgaagtcctcgcgcttctccttgccacaagcttcgcggtcacatcctgcgggtcggagccgcacggcaccgaggagctcgaagcgtcggacatcaccggcacctggcagagcaacaaaggcggccgggtcgtgttcacggaggacggagccgtctcgttcggcaacatcacgcaggaccggtactgcgtcccggaaaacatgcggaacgccgtcccccgcgcatccggtgacggcacatggacgttcgataccgtcccggacgaacgcccgggcgtccggatcgaattcgcgaccggtcacgagcggccggctcactgcgccctgaacgcgatctgggtggggaagcgaccctacgaccagatgtacctgcgtcaggacgacggcaagcgcgagcgctacacaagggattccacggcgcactgagacgaggcctcgcgcgcggggagcgggggaggcgccggttcgccgtcacggacgaaccgacgaggccctcgcccgccccctactcccccagcaggcccgccgcgtccaggatgtacgccaccatcgggtcgtagaagcgggggtcgcggacgtggtcgtccagggggatcgtcacctggagggtgccttccgcctcgccgatgaacagcgccgggtcgttgcagtccgcgtagcccaccgcgtccaggccgcgctgggccgcgcagcccgcccagccgtggtccgcgacgaccaggtccggcagcgggcggttctccgccgcgaggccgtccaggatcgccgccatcggctccggcgagtgcgtgtgccacagcgtcgcgccgcgctccaggaccgcgacgtcggcgaactgccacaccgagccctcgtccgccaccaggccctgcgggatgacgacgatctcgcacccggccgcccgcagggccgccgccgtcacccggtggacgtccaggaggccgcccgggtggccggtggcgaagagcacgctctgccggtccgccgccgccttgcgcagtcgcgccgccaggcggtccaggccgaccacggtcagctccgggtcgatggtgtcctggccgaaccggaacgccgggtcgtccacgaccccgcaccgctccgccatcaccgcgagcacgtcctgctcgtccgtccagcggtcgcccagttccaggccgagccagtagtgccggtcgccgttggcgagcttgcggtagtggctgaggttgttctcgcgcggcgtggcaacctgccccgagatccgggtgcggaccaggtggtcgatgagctcggcgcgggtgggtacgggcgtctctatcggcttcggcatacgggccattctgccgccgccgggccggaggcggcgcgtccattccggtcggcggacgccccggctcacgccgacagcgccccgaacgcgccgtggacgaggcgccgcagcagcgattccaccgcctcgcgccccagggccgccaggtgcggggtggagttgagcaggccgaacaccgcgtgcacggcgacccgtacctccgcctcggcgacctgcgggtgcagttcccgtacgacctccacccacagctccacgtactggcgctgcagctgccgtacgagcttgcggtcggcctcccggagccggtcgagctcccggtcgtgcagggtgatcagcgcccggtcgtcgagcgcgaagtcgatgtggccgtcgacgagggaggacagcacccgctccgggtcgcccgccgcctccgccacccggtgccggccgccggtcagcagccgctcgctgatgccgacgagcagctcggcgagcatggcgtccttgcccgcgaagtgccggtacagcccggggccgctgatgcccaccgcggcccctatctcgtcgacgcccacgccgtggaacccacgcgcggcgaagagacgagcggcctcactgaggatctgctcgcgacgggtgggtgcggccgctctggtgctcatgggaaaccattctagacagggccgttagcggtcgttaacctaaggcccagacacgttaacgaccattaacagcgtgcaccgagcaggtggaacgagcaagggagctcgaccgatgcagcaggcaccagtgctgacgagcgccgcggacccggcgtccgaggcctggcggaccaacgaggccgcccaccgcgagctgaccgagggcctgcgcgcccggctcgacgcggcccggctcggtggcggcgagaaggcccgcgcccgccacaccgcccgcgggaaactcctcccgcgcgaccgcgtggacaccctcctcgaccccggatcgcccttcctggagctggccccgctggccgccgagggcatgtacgggggcgcggcccccgccgccggggtcatcgcgggcatcggccgggtcagcggccgcgaatgcgtgatcgtcgcgaacgacgccaccgtcaagggcggcacgtactacccgatgaccgtcaagaagcacctccgcgcccaggaggtggccctggagaaccgtctcccctgcctctacctggtcgactccggcggcgccttcctccccatgcaggacgaggtcttccccgaccgggagcacttcggccgcatcttctacaaccaggcccgcatgtcgggggccggcatcccgcagatcgccgccgtcctcggctcctgcacggcgggcggggcctacgtcccagccatgagtgacgaggccgtcatcgtccgcaaccagggcacgatcttcctcggcggcccgccgctggtgaaggccgccaccggtgaggtggtcacggccgaggatctcggcggcggcgaggtccactcccggatctccggtgtgaccgaccacctcgcggaggacgacgcgcacgcgctgcggatcgtacggaacatcgtggcgaccctgcccgagcgcggggccctgccctggtcggtcgaggcgccggaagagcccaaggtggacccggacgggctgtacggcgcggtccccgtcgactcgcgcaccccgtacgacgcccgcgagatcatcgcccggatcacggacggctcccgcttccaggagttcaagtccgagttcggccagacgctggtcaccggtttcgcccggatccacggacacccggtcgggatcgtcgccaacaacggcatcctgttcgccgagtcggcgcagaagggcgcgcacttcatcgagctgtgcgaccagcgcggcatcccgctcctcttcctccagaacatctccggcttcatggtcggcaaggactacgaggccggcggcatcgccaagcacggcgccaagatggtgacggccgtggcctgcacccgggtgccgaagctgacggtggtggtcggcggctcgtacggcgccggcaactactcgatgtgcggccgggcgtactcgccccgcttcctgtggatgtggcccaacgccaagatctccgtgatgggcggggagcaggcggcctcggtgctcgccacggtcaagcgcgaccagatcgagggcgcgggccaggaatgggccgccgaggacgaggaggccttcaaggccccggtccgcgcgcagtacgaggagcagggcaacgcctactacgccaccgcgcggctgtgggacgacggggtcatcgacccgatggaaacccggcaggtgctgggactggccctgaccgcgtgcgcgaacgccccgctgggcgactcgggcttcggcatcttccgtatgtgacgtgaggacctcactgatgttcagcactgttctggtcgcgaaccgcggcgagatcgccgtacgggtcatccgcaccctgcgggagctcggcatccgctccgtggccgtcttcagcgacgccgacgcggacgcccgccacgtccgggaggccgacacggccgtccgcatcggcccggccgcggccgccgagagctacctgtcggtcgagcggctgctggacgccgcccggcgcaccggcgccgaggccgtccaccccggctacggcttcctcgccgagaacgccgccttcgcccaggcctgtacggacgccgggctggccttcatcgggccgcccgcctccgccatctccctcatgggcgacaagatccgcgccaaggagacggtgaaggctgcgggcgtgcccgtggtccccggctcctcgggcagtggcctgaccgacgccgaactggtcgcggccgcctcggagatcggcatgccggtgctgctgaagccctcggcgggcggcggcggcaagggcatgcggctggtccgcgacgaggcggtgctggccgaggagatcgcggcggcccgccgcgaggcgcggtcctccttcggcgacgacaccctgctggtggagcggtgggtggaccggccgcggcacatcgagatccaggtgctggcggacgcccacgggaacgtggtgcacctgggcgagcgcgagtgctcgctgcagcgccggcaccagaaggtgatcgaggaggccccgtcggtcctgctcgacgagaagacccgggcggcgatgggggcggcggcggtcgacgcggcccgctcctgcgggtacgtcggcgcgggcacggtggagttcatcgtgccgggcaacgaccccgcctcctattacttcatggagatgaacacccggctccaggtcgagcacccggtgacggagctgatcaccgggctggacctggtggagcagcagctgcgggtggcggcgggcgcgccgctgggcttcacccagtccgaggtgacgctgaccgggcacgccatcgaggcccgtgtctgcgcggaggacccggcgcgcggtttcctgccgtccggcggcaccgtgctggccctgtccgagccctcgggcggtgcggtgcgcacggactccgggctgacggcgggcgttccggtgggctcgacgtacgacccgatgctgtcgaaggtcatcgtccacggcccggaccgcgccagtgcgctgcggctgctgcggggtgctctggccgacaccgtgatcctgggcgtccagacgaacgccggtttcctgcgcaggctgctggcccacccggacgtcgtctccggcgacctggacacggggctggtcgagcgcgacctcccgtcgctcctgccggagggcgtcccggacgaggtgtacgcggccgccgcgctgctggccggcaccgtggcgaagccgcgggcgacggggtgggccgaccccttcgacgccgccgacggctggcgcctcggcggtactccggcctggaccgtccaccacttccgcctgccgggccaggacccggtggaggtccgcacgcgctccctgggcaccgacgcggagatcctcgtttccggccccgccggggcggattcagcctcgccggcgatcggggcgcggggtccggggcagagccccggcgcaccggcccgcggccggatcgtcagccgcaccccggacaccgtcaccgtcgaactcgacggcgtcacgcaccgcttcagccacgccaccagcccggaggggacctggctcggccgggacgcggacagctggcacgtccagcgccacgaccccgtcgtggcgaacctgagcggcgccggccgggccggcgccgacaccctcgccgccccgatgcccggcaccgtcaccgtggtcaaggtggccgtgggcgacaaggtcgcggcgggccagagcctgctggtcgtcgaggcgatgaagatggagcacgtcatctcctccccgcatgccggcacggtcaccgagctggacgtgtccaccggcagcacggtggccatggaccaggtcctggcggtcgtcaccccggacgaggaggagggcgcgtgaaccgcctgcccatgaacgtcccggcccccggtctcccggcccgggtccgcatccacgaggtcggcgcccgcgacgggctgcagaacgagaagggcgccgtcccgacggccgtcaaggcggagttcatccaccgcctcgccgccgccgggctgacgaccatcgaggcgaccagcttcgtgcaccccaagtgggtgccccagctggccgacgcggaggagctgttcccgcagctcgccgacgtcgacgcgcggctgcccgtcctcgtccccaacgagcgcggcctcgaccgcgcgctcgccctcggggccacgcgcatcgcggtgttcggctcggccaccgagaccttcgcgtcccgcaacctcaaccgcaccgtcgccgagtccctcgccatgttcgagcccgtcgtggcccgcgccaaggagggccgggcgcatgtccgcggctatctgtcgatgtgcttcggcgacccctgggagggcccggtcccggtccaccaggtggtctccgtcgccaaggccctgctggacctcggctgtgacgagctgagcctcggcgacacgatcggcgtggccacgccgggccatgtccaggcgctgctcgccgcgctgaacgaggccggggtcaccaccgaccggatcggcgtgcacttccacgacacctacggccaggccctgtccaacaccctcgccgcgctccagcacggcgtgaccaccgtcgacgcctccgcaggcggcctcggcggatgtccgtacgcgaagagcgccaccggaaacctcgcgaccgaggacctggtgtggatgctcgacggcctcggcatcgaaaccggggtcgatctgaccgccctcaccgccacgagcgtgtggatggccgaacagctgggacgccccagcccctcccgtaccgtccgcgccctctcccacaaggagtagtcacaccatgtccctcgaccaccggctcacccctgagcacgaggaactccgccgcaccgtcgaggcgttcgcccacgacgtcgtcgccccgaagatcggcgacctgtacgagcggcacgagttcccctacgagatcgtcgccgagatgggccgcatgggcctgttcggcctgcccttcccggaggagtacggcggcatgggcggggactacctcgccctcggcatcgccctggaggagctggcccgcgtcgactcctcggtcgccatcaccctggaggccggggtctcgctcggcgccatgccgatctacctcttcggctccgaggagcagaagcggcagtggctgccgaagatgtgctccggcgagatcctcggcgccttcgggctgacggagccgggtgcgggctccgacgcggggggcacccgcacgaccgccgtcaaggacggcgacgagtgggtcatcaacggttcgaagtgcttcatcaccaactccggtacggacatcaccggtctggtcacggtcaccgccgtgacgggccgcaaggcggacggccgcccggagatctcctcgatcatcgtcccgtccggcaccccgggcttcacggtggccgccccgtactccaaggtgggctggaactcctcggacacccgcgagctgtccttcgacggcgtacgggtccccctggccaacctggtgggccaggagggccgcggctacgcgcagttcctgcggatcctcgacgagggccggatcgccatctcggcgctcgcgaccggcctcgcgcagggctgtgtggacgagtcggtgaagtacgccaaggagcggcacgccttcggcaaggcgatcggcgacaaccaggccatccagttcaagctggccgacatggagatgcgcgcccacatggcccgcatcggctggcgcgacgcggcctcccgcctggtggccggggagccgttcaagaaggaggcggcgatcgcgaagctgtactcctcgacggtcgcggtcgacaacgcgcgcgaggcgacgcagatccacggcggctacggcttcatgaacgagtacccggtggcccggatgtggcgggactccaagatcctggagatcggcgagggcacgagcgaggtccagcgcatgctgatcgcccgtgagctgggcttcgccggctgagccgaccggcttccggccgagccgaacgcaccggtgtccggggcgggtacgacacccgccccggacatcggcgtgtcaggggtccggtcggcgcctcgcggcaactcggtgccgtgcgccggacggtagggaaatcgggccggtcaccgccggttccgccgggggtgatccaactcacggccggatcttgcccagccgccggatttggccttaggttaggctaaccttctcaccgaacggcccagtggccgcccctgcacgcatgaaagcggacatcgacatgcccaagtcccgaacctcctccttcacccgccgcgggttcgtcgcggccggtggcgccctcggcctcgtcgcggtcctgaccgcatgcggcggcaccgactcggcgaagggtgacaaggacaacggcgcctcggcgtccgccgcctggaccttcaaggacgacctcggcaaggacgtcaccaccaaggccaagccgaagaacatcgtcgcctacaccggcaccgccgccgcgctgcacgactacggcatcaaggtcaagggcgtgttcggcccgaccaagaccaccgacggcaaggccgacgtccaggccggctcgctggacatctccaaggtcgagatcctcggcaacgtctacgacgagttcaacgtcgagaagtacgccgccctgcagcccgacgtgctgctcaccaacacctgggacggcacctactggtacgtcccggaggcctccaaggacaagatcctcgcgctcgccccggccgccgcggtcaaggtgggcggcgacgtcaccctcgacaaggcgctggagcgcaccgcggacctcgccaagtccctcggcgcggacatgaactccaagaaggccgtggactccaaggcccgcttcgaggccgccgccgcgaaggtgcgcgaggccaccaaggccaacccgggcgtcaaggtgctcgtgggctccggctcggacgccctgttctacgcgtccaccccggacaccgcggccgacctgaagtacttcaagcagctcggcgtcgagttcgtcacccccgagaagctggacgagggcggcttcttcgagagcctcagctgggagaacgccggcaagtacaaggccgacgtcatcctgctcgacaaccgcaccggcacgctgcagcccgagcagctgaaggaccgtccgacctgggtcgagatgcccgccgtcaaggccggtcaggtcgtcccccgcgtgaccgagccgatctactcgtacgagaagtgcgcgcagatcctggaagacctcgcgaagtccatccagaacgccaagaaggtcagctgacccccggcgcccggtgaccccgggcgccaggcacgccgtaccgactccccagggggacctctccgcatgaccgccaccgcatccgacgccccggccgtcgcacacttccggttcttcgggctcgaagtgctccgcacgctccgtctgggccactcgttcctgcgggtcaccttcggcggggagtccctcgcgggcttccgctcgggcggcttcgaccagagcctgtcgctcttcctgcccgcgtccggccaggagcacacggtgctcccgtccacggacgaggacacctggttcgccgcctggcgcgggatgacggacgaggagcggccggtgatgcgctcctacacggtgcgcgagcagcgccgtacgcccgagggagcggacgaggtcgacatcgacttcgtcctccacggggacggcagcccggcctcccgctgggcggggcgggcggtggccggccaccggatcatggcgatcggaccggccgtcgcggagaacaagtccgtacgcttccagccgccggccggcgccgacgcgatctggatgtacgcggacgagaccgccctgccggccgcggccgcgattctggaccggctccccgccgggacccgggtcagggcctggttcgaggtcccgcacgaggacgaccggctcgacctccgggcgcccgccgacgccgacatcacctggatcgtgcgcgagagccacggccgggagcggacggagcaggtgctgagcgtgctgcgctcggccggacccgcagcggccgaagccccgtacgcctggctggcgggcgaggcgggcacgatccgcgcggtgcgccgccatttcgtgcaggaacgttccgtcgaccgtcgcgccgtccgcttcaccggctactggcgcctcggcgcgagcgaggaacagctcctcgccgaggcgtacgccggcaaggccccgagcgaggacccggcctccgagctctagtcaactcccggatttcacaccgcatttgagatgggccctggcttttcagccagggcccatctgcgtttggcgaattactaaggttaggctaacctaattcacgcacaccccaccccaccccccccctctccaccccctgcccggaggaaagttgatgcgctcgcatctgctgaacgagacgaccgcggacctctaccggcgctccgtcaccgagggcgtcgaccgcgtcgccgcgaaactcgcgagcacgcagcggccccacaccggtatatccgtcgacgaactcgccccggtcatcaacgggatcgacctggacaagccgctcgcggacgcggccgccgtcctggacgagctggaggacgtctacctgcgcgacgcggtgtacttccaccacccgcgctacctcggccacctcaactgcccggtcgtcatccccgccgtgctcggcgaggcgatcctctcggccgtcaactcctccctcgacacctgggaccagtccatcggcggcacgctcatcgagcgccgcctcatcgactggaccaccgagcgcatcggcctcggccccgccgcggacggcatcttcacctccggcggcagccagtcgaacttccacgcgctgctcctcgcccgcgacgaggcctgccgcctcgtcatgaagaaggcgctcgacgagggacgcgagctcaccaaggccgaactcctcccgaagctgcgcatcttcacctccgaggccagccacttcagcgtccagaagtcggccgccatgctcgggctcggctacgaggccgtcatctgcgtcccggtcgaccgcaaccgccggatggacaccgcggtgctcgccctggaactggaggagtgcgcctccgagggcctcttcccgatggccgtcgtcgccaccgccggcaccaccgacttcgggtccatcgacccgctccccgagatcgcccgcctggccgacgagcaccacgcgtggatgcacgtggacgccgcctacggctgcggactgctggcgtccccgacccgccgccacctcctcgacggcatcgagcgcgccgactcggtcacggtcgactaccacaagtcgttcttccagccggtcagctccagcgccatgctggtgcgcgaccgcgacaccctcaagcacgccacgtaccacgcggactacctcaacccgcgccgcatggccgaggagcgcatccccaaccaggtcgacaagtccatccagaccacgcgccggttcgacgcgctcaagctctgggtgaccctgcgcgtcatgggcgccgacggtgtcggctcgctcttcgacgaggtcatcgacctggccgcggccggctgggacgtcatcgacgccgacccgcgcttcgaggtcgtcgtcaagccgcagatctccaccctcgtcttccgctacgtccccgagggcgaggtccgtaccgacctggtcgacgaggccaacctgcacgcccgcaaggccctgttcgcctccggtgaggccgtcgtcgccggcaccaaggtggacgggaagcagtacctgaagttcaccctcctcaacccgcagaccacgacggccgacatcgcggccgtcctcgaccttctcgccgcacatgccgagcagttcctgggagaatcccttgccctccaccgctgagacccacgacttcatcggcatcggcgtcggtccgttcaacctcggactcgcctgcctgaccgccccgctcgacgagatcgacggtctcttcatcgagtcgaagccgcacttcgagtggcacgccgggatgttcctggacggcgcccacctgcagacgcccttcatgtcggacctggtcacgctcgccgacccgacctcgcccttctccttcctgaactacctgaaggacaaggaccggctgtactccttctacatccgggagaacttctacccgctgcgggccgagtacaacgactactgccgctgggccgccgaccgcctcgacaacgtccggtggtccacctcggtcaccgaggtcacctacgacgagcgggccggcctgtacgaggtccacaccgacaagggcgagacccaccgggccccccgcctggtcctgggcaccggcaccccgccgcacgtcccgcagtcctgcgagggcctcggcggcgacttcacgcacaactccgcctacatgcagaacaaggcggagctgcagaagaagaagtcgatcaccctcatcggctccggccagagcgcggccgagatctactacgacctcctcgccgagatcgacgtccacggctaccagctcaactgggtgacccgctccccgcgcttcttcccgctggagtacaccaagctcacgctggagatgacctcccccgagtacgtggactacttccacgcgctccccgaggacacccgctaccggctggagacccagcagaagaacctcttcaagggcatcgacggcgacctgatcaacgccatcttcgacctgctctaccagaagaagatcagcatgccgggccaggtcccgaccaccctgctgaccaacacctccctgaacagcaccgcgtacgacaccaccacgggcacgtacacgctgggactgcgccaggaggagcaggagcgggacttctccctcacctccgagggcctggtcctggccaccggctacaagtacaccttcccggagttcctgaacccggtgcgggaccgcctgaacttcgacgggcacggccggctcgacgccgcccgcaactacagcatcgacaccacgggccgcggggtctacctgcagaacggcaccacccacaaccactccctcacctcgcccgacctgggcatggcggcgtaccggaacgcgtacatcgtcggtgagctgctcggccgcgagcactacaaggtcgagaagtccatcgcgttccagcagttcgccgccccggaaggcaccctctgatgagcaccaccgaactcctcttctcccgcgtcgacacggaactcggctccttctccgtgcgccccctggaccccttcgccgacgcggagctgctccacggctgggtcacccacccgaaggcgtcgttctggatgatgcaggacgcgtccctgccggacgtcgagcgcgagtacatgaggatcgccgcccacgagcaccaccaggccttcatcggcctgcacgagggccgccccgccttcctcatggagacctacgacccgtccgagctggagctggtcggcctctacgaagcccagcccggcgacgtcggcatgcacttcctcgtcgcccccagcgacaccccactgcacggcttcacccgcgccgtcatcaccacggtgatgtccgcgatcttcgccgacccggccaccgagcgcgtcgtcgtcgagccggacgtcgccaacaccgccgtgcacgcactgaacgaggccgtcggcttcgtgccggagcgccaggtcaccaagccggagaaggaagccctgctgagcttctgcacccgcgcgcagttcgaggccgccacggccgcccagggggtctccatatgagcctcgccgacgccgtcgcccacctctcccccgagctgtgggcccgcgccaaccgcgccctggtccgcaagggcctcgccgagttctcccacgagcgcctgctgaccccgaagccgctgggcggcggcctctactcggtcctcagcgacgactcgaccgtggagtaccgcttcaaggcggtcctgcacgccctcgaccactggtcggtcgacgaggcctccatcacccgccaccgtgacggcgccgagctggagctggacgccctcgacttccacatcgagctgcgcgaggccctgggcctgagtcccgaggtgctgcccgtctacctggaggagatctcctccaccctggccggcacgggctacaagtacacgaagccgcaggtctcctccgacgtcctcgcgaagtcctccttccaggacatcgagacgggcatgaccgagggccacccctgcttcgtcgcgaacaacggccggctcggcttcggcgtgcacgagtacctctcgtacgccccggagaccgccagccccgtccacctggtgtgggtggccgcccgcaaggacgtctccaccttcacggcgggcgcgggcctggaccacgactccttcatgcgcgaggagctgggcgacgagaccatcgccgtcttcgcggagcggatgaccgcgctgggcctggacctggccgacttccacctcttccccgtgcacccctggcagtggtggaacaagaccacggtcaccttcgccgccgagatcgcgaaccgccgcctggtgctgctgggcgagggcccggacgcgtacctcgcgcagcagtcgatccgtacgttcttcaaccggagcgcgccgcgcaagcactacgtcaagaccgccatctcggtcctgaacatgggcttcatgcgaggtctgtcggccgcgtacatggaagccaccccggcgatcaacgactggctgcaccagctgatcgagggcgacgaggtcctgaagtcggtggacttctcgatcatccgcgagcgcgcggcgatcggctaccaccaccgccagtacgagcgcgccaccgaccggtactccccgtaccgcaagatgctggccgcgctgtggcgcgagtcccccgtcaaccggatcgagggcgacgagcgcctcgccacgatggcctcgctcctgcacgtggacgccgagggcaagtccttcgccggcgcgctgatcgcggagtcgggcctgaccccggccgagtggctgcgccactacctgcgcgcctacctggtgccgctgctgcactgcttctaccagtacgacctcgcctacatgccgcacggcgagaacaccatcctcgtcatcgagggcggcctggtgaagcgggcgatcttcaaggacatcgccgaggagatcgtcatcatggacgcggacgcggtgctgccgcccgcggtcgagcgggtccgggcggacatccccgaggacatgaagctcctgtcgatcttcacggacgtcttcgactgcttcttccgcttcctcggcgcgatcctcgcggacgagggcatctgcgacgaggacaccttctggcgggcggtcgcggactgcggccacgagtaccaggagtcgatgccgcagctcgcggagcgcttcgcgcggtacgacctgttcgcgcaggagttccagctgtcctgcctgaaccgcctccagctgcgcaacaacaggcagatggtcgacctcgccgacccggcggcggccctccagctgatcggcagcctccagaaccccgtcgcggccttcgcccggcggtgacacacggggcgggggaggcatcgatacggtccctcggtgcctccctctccccaccccggaacctcgacggcgtgaccgcgaagcacaatggccctcttcgcggtcacgccttcgtgtgtccgctccggtggccggagtgcgcggcccgagtccgtctgggagcccgtatgccgatccggatccgccccggccgtgcggccgccctgctcctgtcggccgcgatcgtggccggtgggctgtccggctgctccttcctgtccccgttcaagacctgcgaggggaccggggcgcggatgaaggagctggagtcgctgccgctgctctcctcgccgccgcccggcgcgagcgccccccgcaccttcgacggcgtctactccgagtgcgcggacgacagcggtgacgcctggctgtccgccgggcgcacctacgtgtaccccggcacccgccaggaggtcctcgaccactaccgcaaggccgccgaggccgacggctggcggttcgagcccgaacggacgcccgatcaggggaggttcggatcgtgcttcacgaagggcggggacgggcaggccaaggtgttcaccctctccttcccgcccgtccgcctcctcaccgagttctacggtcccggggccgccgcggagttcgccacgggggccggattcgagataacggtgggctcggaggccgacggggccgagacctcctgctggtcctgaccccgtccgccagcggtcactgccagggaacgtccggcgcccggaagaaggcgatgccctgcgcgtccagccggggcgcctgcgcggccaggcggcggctgtaggaggtccagtcgagcgcggccgccggcgaccagcccagttcggccaggcccagtacccgcgggaaggccatcagctcccagtcgccgcgcgtcgcgacggtctccgtccacagcggggcctccacgcccagcaccgccgactccgggaccccggccaggtacgcgcccgggtcccaggagtaggcgcgccgcaccgggacgtaccccgcccaggccaggcccggcttcgtggccgggtcgtacttcatgtccaggtacagccggtccgccggcgacaggatcagcgggtgccccgcccgggccgccgccgccacggccgccttgtccgcggccgcggtcttgtcgtggccccagtactggagcaccgcgccccgggccgggcgggccgccgccagctggtgccaggccaccaccgtcttgccgtaccggcccaccacggcctgggcccggtccatgaaggccgcgtagtccgccgcgggcgtcgcgtgcgcctcgtcgccaccgatgtgcaggtagcggccgggggtcagctccgccagctcgccgaggacctcgtcgatgaactcgtacgtccgctccttgcccacgcacagcgagctgaagcccaccttgacgccggtgtaccgctccggggccttcccgtcgcagttcagctcggcgtaggaggcgagcgccgcgttcacgtgccccggcatgtcgatctcggggaccacgtccacgtaccgctgccccgcgtaggccaccaggtcccggtactcgtccttcgtccagtggccgccggggccgcccccgacctcgctgccgcccccgtactccgccagccgcggccaggagtcgatcgcgaggcgccacccctggtcgtcggtcaggtgcaggtgcagggtgttgaccttgtactgggcgagctggtccacgtatttcttgacctgctccaccgagaagtggtggcgcgcgatgtcgaccatggccccgcggtacgcgaagcgcggccggtcggtgaccgtcccgcccggcaccgtgcccgggcccgccaccggtaccagctggcgcagcgtctgccccgcgtggaagagcccggccggggtccgcgcggtgagggtgaccccggtcgggccggactccagccggtacccctcgtcgcccaccccctgcgccccctcgtcgatcctgagccggatcccgtccccctgcgcgccgtcgaccaccggcagcggcagcccgctggggccgcgcagctgctcggcgaggagctcgcccacccggcggacctcctcgtccgggccccggccggtgcggacgaccgtgcccgcgccgaaggagtagccggggccctcggcgcgggcggagacgggcgcgggcagcagccgttcgaagggggcgagggccaccggcgggtcgtccccgggccgggcgtcgtcaccgtgggcggaggtgcaggccgtcaccagggccggggccgtggcgagggcgaggagggcgccgagcgtgcgtcgcaggactctcatgcgcacaggtataggccaagcgggccgtcccgtccggcgggtgaatccgggaccggcggaaatcatccgaaggaggtcacgggacgggcgaaccgagcgcttcactggtccagaccagagcattcctgcccgatatcgggcaggaactttgcgttcgacgccgcgagccgccaatatctacgagtgctcgatcgccgcccgtcgcatgacgacctcgtcgaccacctggtgcgcagcaccgcgctgcagcgcggtgaggcagcccgggtggtactggacgtgctcgcctacttcgacgagacgaccgaggagttcgtccgccgccgccaccgggaactgcagtccggcggagcggtgaacgcggagatcttcgagcggatcgcggccgagctgccgcaccgcgccgtggcgccgccggagctctcgctccggcagttgcgccgcatcgtctacggctgagccggcggccgccgcacgcggccacggacgagtacagaaccgaacttcaggaggggcagaaccgtatgtgtggaatcgtcggttacatcggcaagcgtgacgtggcaccgctgctgctggaaggcctgcagcggctggagtaccgcggatacgactccgcgggcatcgtggtcaacaccccgaaggctcccgccctgaaggtcgtcaaggccaagggccgcgtccgcgagctggagtcccgcgtccccaagcgcttcgccggcaccaccggcatcgcccacacccgctgggccacgcacggcgccccgagcgacctcaactcgcacccgcacctggaccccgagaacaaggtcgccgtcgtccacaacggcatcgtcgacaactgctccgagctgcgcgccaagctcgaagccgaaggcgtcgaattcgtctcggagaccgacaccgaggtcatcgtccacctgatcgcccgctccgaggccgactccctggaggagaaggtccgcgaggcgctcaaggtcatcgacggcacctacggcatcgccgtcatgcacgccgacttcgccgaccgcatcgtcgtcgcccgcaacggctcccccgtggtgctgggcatcggcgagaaggagatgttcgtcgcctcggacgtcgccgcgctggtcgcccacacccgccaggtcgtcaccctcggcgacggcgagatggccaccatcaaggccgacgacttccgcacctacacgacctccggtacgacgaccaccgccaccccggagaccgtggagtgggaggccgcctcgtacgacatgggcggtcacgacacctacatgcacaaggagatctccgagcagcccgacgcggtcgaccgcgtgctgcgcggccggatcgacgaccgcttcaacaccgtccacctgggcggcctgaacctggacccgcgcgaggcgcgcggcatccgccgggtcaagatcctgggctgcggcacctcctaccacgcgggcctcatcggcgccggcctcatcgagggcatggcccgtatccccgcggacgccgagccggcctccgagttccgctaccgcaacccggtcgtggaccccgacaccctgtacatcgcggtctcccagtccggtgagacctacgacgtgctcgcggccgtgcaggagctcaagcgcaagggcgcccgcgtcctcggcgtggtcaacgtggtcggctccgccatcgcccgcgaggccgacggcggcgtgtacgtgcacgccggccccgaggtctgcgtcgtctccaccaagtgcttcaccaacacggtcgtggccttcgccctgctcgccgtgcacctgggccgcatccgggacctctcggtcaccgacggcaagcggatcatcgagggcctgcgcaagctgcccgcgcagatccaggagatcctcgacggcgaagaggacatcaagaagctggcgagcgagttcgccgaggccaagtcgatgatgttcatcggccgggtgcgcggctacccggtggcgctggaggcctccctcaagctgaaggagatctcctacatccacgccgaggcctacccggcctccgagctcaagcacggcccgctggccctgatcgagccgtccctgccgacggtcgcgatcgtcccggacgacgacctgctggagaagaaccgcgcggcgctggaggagatcaaggcccgcagcggccggatcctggcggtcgcccaccgcgagcaggagaaggcggaccacaccatcgtggtcccgaagaacgaggacgagctggacccgatcctgatgggcatcccgctccagctgctggcgtaccacacggccctggccatgggccgggacatcgacaagccgcgcaacctggcgaagtcggtcaccgtcgagtagccgccgcccccacagcgaggaacccccgcgcgcgtgcgcacgggggttctctgccgtggtgcccggcccggtttccgcgccggtcagcccgcggcgaccgcgccgcgcccggccttgccgaaggccatcggccagtgcgccagtgccgcggtggcgccgtaccaggccagcagcccggagacggcggcgacccagccgcccgccttggcgagcatgccgttgtccacgaacgcgcctatcgccagcaggagcagcgacagggtcagcagggcgtagacgccctggctgaacagaccgctcgcggcggcgaccgtgagggtcagcgcgagcatcgcgaacaggacaagaaacgttccggcggcctcgtcggagaccgaaccgcccgcgcccttggcccaggtgaaccagaagacgccgaggcccgcgaacgcggtgccgttgaacccgtcgccgccgcggtactcaaggagaccgaggaggaagagggccgcgccgccgacgtacatcgcgagcgacacggaactggcagcggacacgccgtcgatgacaccggtgtggccgataccgaatgcgagaagggtgagacccagggcgatgttcccgagggtcgaagtcgaggccgtgcttcccgcagagacaccattgtccacggcgggctcccttcgatctgcagttgtttgctgcgtcccagcagcacttatctaccctttacacaggggcacaaccgcacaagcgccttaacaagcggtcacgaactgacaacggcgagcgatcggaccggccgttcgtacgagggcgcgtgagccaaggcccccttcccccagggaggggcggtcagggaatgacgaccaccggtcgctgtgcgcgcttggccagccggccggccaccgatccgaagatccggcccacgatcccgtgggtggagccgaccacgatggcgtcggccgaatactcccggccgacctcctccagctcatggcagatgtcaccaccgcgctcgaccaggatccacggcacttcggccagatagtccgcgcaggcgagctccagcccgagcacctcggtgcggtggtccggcacgtcgacgaagacgggcggctcgcagccggcccacaccgtggtgggcagccggttggcgacatggacgatgatcagaccggatccggagcgacgggccatgccgatcgcataggcgagcgcgcgctcgctggaggtggatccgtcgaatcccacaacgactccgtgccggaaggccggatcgcagtgcacgcgtgtctgttccaccgcgcgcagatcggcggccgacgaggggtcgacgacgcgtttgcgcttgcggtccgcgggttcggagaattcgtgaccggccatgggtgtctcggcgaagaggtccttggaggaagcaacaggggcgaaatcggcgacgcagtgtgacggagctctgtccgggaagcatcttcccaagcccatacccaccagggtacggcgacactcctgtcctgcacagggcatgccgcccttggagagcgtcccagggagcatgccggagcgagcgcgccttggcaatgaccactgtcccctacagccagtgacgagtccggccatcaacacccgtgcgcgcagtgaccgagccccgccgccgggcgttgggacatgcgtccgaccaacaggtaagagcccgcagggagtacgccgtgcccggtcatccggttcaccccgtccagccagctcagccgaagcagtccgtccggtccctccagaacgccgaccccgccgcgcacttcaccccgcccgcccgctcgggccttcacccgtccgggcgttccgccggacacccccatgacgaccccgcgggtgacgtcgtgcgctgggcggccttcagctgcctgctcgtccccgtggtcctggtcgtctacggaacctcctacggcggggccgccgtcgcgaccctcggcctgctcgccgtgacggccgcgtgccgggtcctgctgcgccactcggagaggaaccagcgggccgcggcccgcgtgctggtggaggagtcccttccgcccgcccaccgcggccggcactcgcgcggcgcgaccgggaaccgccgcggctgccggggctccggcccggcagccccgcaggactgactcattcgcacacccacacaggcatgttttcagccaacttcccggcaggatgccctccttgccggaatgtccccccgtccccctcaccaccagcgacgacagaccccgggggacgttctggccctaccggtactggccatggccgggcaccgcgcttcccgttcgggtagcggagtggaacgcttactgatcgaatgcttttcgccaagttgagaagtcgacatagcgctgcgtgctgaacttgtcacgccgacaccacgggacgcagtagattcgatcatgtatttacggcgggggatccacgtgcaaggccgaggggaaacgtgcaggtgcgaccagaccaaggagtcgcgacacccaaggggggcttagcgccatgagccaggattccatcaccgtcgtcaacgacgccggccggaagctcgcggggcgtcgccgcagggagatcgtcgcggtgctgctcttcagcggcggaccgatcttcgagagctccattccactttccgtgttcggcattgaccggcaggacgcgggagttccacgctatcgactgctcgtgtgcgccggagaggacggtccgctcaggaccaccggcggactcgaactgaccgcgccgtacgggttggaggcgatcgcccgggcaggcacggtcgtcgttcccgcctggcgctccatcacttcaccgccgccgccggaggcgctcgacgcactgcgtctggcgcacgaggagggggcccggatcgtcggactgtgcacgggggccttcgtgctcgccgccgccggtctgctggacggccggcccgcgacgacgcactggatgtacgcgccgacgctggccaagcggtacccgtccgtccatgtcgatccgcgcgaactcttcgtcgacgacggcgacgtgctcacgtccgccggcacggcggccggaatcgacctgtgcctgcacatcgtgcgcacggaccacggcagcgaggcggccggggccctggcccgcaggctcgtcgtaccgccgcgccgcaccggcggccaggaacgctatctcgaccggtcgctgccggaggagatcggcgccgacccgctggccgaggtcgtcgcctgggccctggaacacctccacgagcagttcgacgtggagacgctggccgcccgcgcctacatgagccggcgcaccttcgaccggcggttccgctcgctcaccggcagcgccccgctccagtggctgatcacccagcgggtgctccaggcacagcggctcctggaaacctccgactactcggtcgacgaggtcgccggacgctgcgggttccgttccccggtcgccctgcgcggccacttccggcggcagctggggtcctcccccgccgcctaccgctccgcctaccgggcgcgccggccgcaggccgacgtggcacaggtggccgagatcaacgcgggtccggttccgcaccagcgcaccccgcagccccaccgggcggcggcggccctggccgcggcgggtcccacggtcacggagctgtacgccccgggccgggtcatgcgggaacacgcctgaccgcacactgagtacgacgcacgaaggtcccccagcggtcaccgccgatgggggaccttccgcatatgcggtccgcgccacgggggaccgcataaggtgggacacatgaacgatcgcatggtgtggatcgactgcgagatgaccgggctctcgttgacggacgacgcacttatcgaggtggccgcactggtcaccgactcggagctcaacgtgctcggcgaaggcgtggacatcgtgatccgcccgccggacgccgcactggaaaccatgcccgacgtggtgcgcgagatgcacaccgcctccggcctgctcgacgagctggccggcgggaccaccctcgcggatgccgaggcgcaggtcctggcctacgtgcgggagcacgtgaaggaaccccgcaaggcgccgctctgcggaaactcggtgggcaccgaccgcggcttcctgctgcgcgacatggccgcgctggagagctacctgcactaccggatcgtggacgtgtcctcggtcaaggagctggcgcgccgctggtacccgagggcgtacttcaacagcccgccgaagaacggcaaccaccgggcgctggcggacatcaaggactcgatcaccgagctgcgctactaccgggaggcggtcttcgtaccgcagcccgggccggactcggacacggcccgcggcatcgccgccaagcacgtcgtgccgggcgcgtagctccggccgggccctccggagaggggcggccgggaaaggggggagcgagcaccctcccggaccctgtacccttttcttcggccggtcggttttccgaccggacatggtgggtgtagctcagttggtagagcacctggttgtggtccaggtggccgcgggttcaagtcccgtcactcaccctgcgggaaggccccggttcgcgagagcggaccggggccttctgcatgaccgggctttctgccgaccaggccgtccgcccggccggggccgggcccgtcaggacgactcccggaccaccagccggttcggcaggacggcggccgcctcgcccgcctcccccgctattctccccagcagcatccgcgtcatggtccggcccatctcctcgatcggctgccggacgctggtcagcggcgggtccatgtgccgggccaccaccgagtcgtcgaaacccaccagcgccacgtcccgcggaatccgcaggccggccgcgcgcagctcccgccgggcgcccgccgccatgacgtccgaggcggcgaagacggcgtcgagcgcggggcggcgctccagcagttcccgcatggcccgccggccgccctcctcggtgaagtcgccgaccgcgatcagcagctcgtcgacggggtgccccgcggcggccagggcctgccggtagccgtcgaggcggcactgggccccgtacacgtccagcgggccggtgatcgtggcgatcgtgccccggccccggtcgaggaggtggcgcacggcctcggccgcacccgccaggttgtcggagtccacgcagggaagggtctcggcggcggaacggcggccgctgatcaccgtcgggatgccgagctcggccagcagctccggcagcgggtccccggcgtggacggagacgagcagcaccccgtcgacgcggtgcccggacaggtactgggcgaggcggcggcgctcgcggtcgctgcccgccagggtgaggacgagctggacctcggtgtcggcgagctcggcaccgaccccgcggaccacttcggagaagtagggctcggcgaagaagcgggcctcgggctcggggatcacgagggcgatggcgtcggtccggttggcggcgagggcgcgcgcggcgcggttcggtacgtacccgagctcggccacggccgcctcgacggcgaccctggtgtgctcgctgaccttggaggatccgttgatcacccgggagaccgtgccgcgcccgactccggcgcgcgccgcgacctcctccagggtcggtcgtcccccactgcgcccgtgcccgttcatggcttcctcccggttgtgaatctaccccttgacgactgtgggagcgctcccacactgtgtcacacgacacccggcacgtttcgcccttctgggaggaagcacatgcgagcccgagcccgagtccgagtccggagaaccctcctcacgaccgtcgccgcggtcggaaccacggccctgctgctcgcggggtgtgcgcaggaccccgacgaaagccccgaccagggcgcccccgccaccggcaagtccggcggcgccgcacagaccaccctcaccgtcggggtcttcggggccttcggactccaggaggccgggctctacgacgagtacatggcgcagaaccccgggatccgcatcgagcagacctccatcgagcgcaacgagaactactacccccagctcctcacccacctgggcacgggcagcgggctcgccgacatccaggccgtcgaggtcaacaacatcgccgagatcaccgccacccaggccgacaagctggtggacctgggcaaggcccccggtgtggacaaggccgcgtacctgccctggaagtgggcgcagggcacggcgcccgccgccaagggcggggccacggtcggcctcggcaccgacataggcccgcagggcatctgctaccgcaaggacctcttcgaggcggccgggctgccctccgaccgggcggcggtcggggccctgtgggcgggtgactggaacaagtacctggaggccggccggacgtacaaggccaaggccggcgaggggaaggccttcgtggactcggcgtcgggcgtgatggcggcggtgaccgggagcagcgcccagcgcttctacgacgaccagggcaaggtcgtctacaagaccaacccggcggtgcgcggggccttcgacctcgcggcctccttcgccaccgacgggctgagcgccaagctccagcagttcaccccgacctgggaccagggcttctcgaacggctccttcgccaccgtctcctgcccggcctggatgctcggctacatccaggacaaggcgggttccgcgggcaaggacaagtgggacgtggcgcaggcgccgaagcccagcaactggggcggctccttcctggtggtcccgaaggcgggcaagcacgccgaggaggcggcccggctggcggcctggctgacggcccccgcgcagcaggcgaagctcttcgagaagcggggcagtttcccgagcgcgagcgccgcgtacaagcttccggcggtgtcgggcgcgcagcacgcgtacttcggcggcgccccgatcggggagatcttctcgaaggcggccgagggcgtgccggtggcggcggtcggaccgaaggacctggtgatcgcgcagaacctggcggacatcgggatgctccaggtcgaccagaagggccgcagcccgcaggagggctgggaggccgcggtgaaggcgatcgacaacgccctggaccagtgaggcagcggtgacggacgagacggttgtcctgtccccctccgccgtcggccccgagcggccggcggcggaggggggcggccggagcgggcggggcgggcgcgcccaggtgtggcgctcgcgccgctaccgctgggacctgcgcttcagcccgtacgccttcgtggcgcccttcttcctcttcttcgccgccttcgggctgttcccgctgctctacacgggctgggcggcgctgcaccaggtggagctgaccgatcccgacagcatgacgtgggtggggctgcggaacttcacccggctgtgggacgacgagttcttctggaacgcgctccgcaacacggtgaccatcgggctgctgtccacggtgccgcagctggcgatcgcgctgggcctggcccacctgctcaactaccggctgcggggctcggccttcttccgggtcgcggtgctcaccccgtacgcgacgtcggtggcggcggccacgctcgtcttcgtgctgctcttcggccgggactacggaatggtcaactgggcgctgtcggcggtgggcttcgaggccgtcgactggcagaacggcaccttcgcctcccagttcgcggtctccaccatcgtgatctggcggtggaccggctacaacgcgctgatctacctggcggccatgcaggccgtaccgggcgagctgtacgagtccgccgcgctggacggagcctcgcgcttccagcagttcctccacgtcacggtgccctcgctgcggccgacgatcttcttcacctgcgtggtgtcgacgatcggggccacccagctgttcggcgagccgctgctgttcaacggcggggcggccgcgacgggcggctcggaccaccagttccagacgctcgggctgtacctgtacgagcagggctgggtgaacctgcacctcgggcgggcctcggcgatcgcgtgggcgatgttcctgatcctgctgctgatcgcctgcgcggcgcggctgctgcgcggacggaaggactcccgatgaggtcactgcgcgcgggccggctcacgtacgtggtgctcgccctgttcacggccggctccctcttcccgctcctctggacggcgatcgcggcctcccggaccagtacgcggctggcccagaccccgccgccgttctggttcggcgggaatctggggcacaacctccaggtggcgtggaccgacgccaacatggggacggccctgctgaacacggtgatcgtggcgggcacggtcgccgcgggcaccgtgttcttctccacgctcgccggcttcgccttcgccaaactccgcttccgcggcagccggccgctgctggcactggtgatcgggacgatgctgatcccgccgcagctgagtgtggtgccgctctacatgctgatcgcgaagctgtcgtggaccgaccggctccaggcggtgatcctgccgaccctggtgggcgccttcggggtgttcttcatgcgccagtacctggcgcacgcgctgccgatggagctggtggaggcggcgcggacggacggggcgagttctctgcgggtcctgtggcacgtggtgttccccgccgcccggcccgcgatggccgtgctggggatgctgaccttcgtcatggcctggaacgacttcttctggccgatcgtcgcgctgacccagaacggcagcccgacggtgcaggtggccctgaccgggctgggccggggctacatccccgaccagtcggtgatcatggcgggtgcgctgctgggcacgctcccgctgctgctggtgttcctcgtcttcggccggcagatcgtcggcggcatcatgcaaggagcggtgaagggatgacccaactcccgacgaacacgaacacggacgtgagtacggacgtgagcacggacaccggtgggcgggagctgcgcttccccgacaggttcctgtggggaacggccacggcggcgttccagatcgagggcgccgcctccctgcgcggaccgtccatctgggacaccttctgccgtacgccgggcaaggtccacggcggcgacacgggtgacgtggccgtcgaccaccaccggctgtggcgcgaggacgtccggctgatggcctcgctcgggctcggcgcctaccggttctcggtgtcctggccgcgggtcctcgccggcgggatcggcttctacgacgcgctggtcgacgagctgctctcgtacgggatccggccctgcgtgaccctgtaccactgggacctgccgcaggagctggagagcgcgggcggctggcccgagcgggagacggcctacgccttcgcccggtacgccgagcaggtcacggcggcgctggccgaccgggtggagctctggaccaccctcaacgagccctggtgcagcgccttcctcggctacgcctcgggggtccacgccccgggccgcacctcccccgccgactcgctgcgcgccgcccaccacctcaacctggcccacgggctggccgcggcggcgctgcccgccgggaccagggccggtatcgcgctcaaccccagcgcggtacggccgctgaccggctcggcggccgacctggacgcggcccgccggatcgacgcgctggccaaccgggtcttcacgggcccgctgctgcacggggcctacccgcaggacctgctcgcggacaccgccgcggtgacggactggtccttcgtccgccccggcgacgaggcgctgatccaccagccgctggacttcctcggggtgaactactacaccccggcggtggtctcggccgcccccgacgggaacggcccgcgcgccgacgggcacggggccacggagcactcgccctggcccgcggcggagtcggtcgccttccaccaaccgccgggcgaccgcaccgacatgggctggtcgatcgaccccaccggcctgtacgacctgctgatgcgcttcacccgcgaggcccccggactgccgctgctggtgaccgagaacggcgcggcgtacgccccggacctgcacgacccgcagcgcatcggctacctggaggcccacctgtcgtccgtccaccgcgccctggcggacggcgccccggtggaggggtacttcctctggtccctgctggacaacttcgagtggtcctacgggtacagcaagcgcttcggcatcgtgcaggtcgactacgagacccaggcccgcaccccccgctccagcgcccactggtacgcccgcctggcccggaagggaagcttccacacctacggggacgaggtgctctagccggcctagcggaaagccgcggccgagcgggccgcccagtccgcgaacgggcggggagcccggccgaggatctgccgcacgtcgtggctcggctccagttcggcgggcaggggttcgccgaggatcccgagggtgccctccacgaccggctcgggcatgaaggtcagcatccgggcgcgggcctcctcccgcgtctgctcgacgaagcgcacgggctcgcccagggccgcgccgatcgcctcggcccgctccctcggggtgaccggggcgggcccggtgagctcgtacgtccggcccgcgtggcccggctcgcgcaggaccgcggccgcgacctcggcgacgtccgccgggtcgacggtcgggagcccgacgtcgccgaagggcgcggcggcggtgcgcgtcgtacggatggtctcggcccaggcgtaggcgttggagtcgaggccgccggaacgcaggaccgtccactccaggccgctgcggcggacggcgtcctcgaaccgcgcggggtgggcgtacacctcggggcgggttccgacgccctgggacgagagcagcacgacccggcggatcccggcggccgcggcccgctccaggatgccctgcgggtcctcgccggcgacgagcaggaacagcgccccggccccttcgaacgcggggccgagaccctgcggttcggcgaggtcgccctgctggtggcggaccccctcgggcatgtctcccgcccgccgggagacggcggtgacgcgctcgccgtcgtcggcgaggatccgtacgagttcccgtcccacgttccccgtcgcacccgtcactacgatcacgatgatcccccttgtgagttagtcggctgacttactcaggaccatagcccgttcccgatcactcgtctagagtcagtcaggtgactgactcaaagaagagccggcgggcgtccggcaagcgggagcggctggcggccgccgcggccgaggttctccacgcccagggcgtcgcccagaccacgctcgcggacatcgcccaggcggccgaggtcccggtgggcaacgtctactactacttcaagaccaaggacgagctcgtcgaggccgcgatcgacgcacacgcccggacgctcggggggatgatcgccgcactcgacgaactccccacccccgaggagcggttgaaggccctgctggccggctgggtcgaacagcgcgagctcaccgcccggttcggctgccccaccggcaccctcgcctcggaactcgacaagcgcgccgacggactcgaccggtcggtcgccgccgtcatgcagaccctgctcgactgggccgagcagcagttccgcacgatgggccgggccgacgcccgcgagctggccgtcgccctgatcgcctcctaccagggcatctcactgctcaccaacacgttccgcgaccccggcctcatgaccaccgaggcccgccgcctggaacgctggatcgactccctcggctgagggccccgccaccggagacgacgatgcacacagctgacggaccgggccgcacccgcaccacacccccgcgccccctggacgtggagtccctcttcccggacctcgccgcccaccgccgcaccgcgacccggctgcacccgcgcccgggcacacccgggccgcacgacagccatgtgggcggacctctgctgtggcccgccggcgaaccgtggccggtgtgcacgaccccgcaccggcgcgcccccgggccgggaccgctgccgttgctcgccctggcccaactgcacgcccgggacgtgccggacctgcccgccggtccggacggctgcgatctgctccaggtgttctggtgccccttcgacgcccacgggccgaccgggtacggcatgtacgtgcacctgcgctggcgccgggcggcggaggtccgcgaaccgacggcggagcggccggcacccggagccgtcggcttcgacgggtacctgcccgagccgtgcctgctgcacccggagcgggtcaccgagtacccgtacatcgagctgctcgacggggagctgggggcggcggtcgaggagtgggaggaggcccaggaggaggcccaggaggaggccgcggacgaggacggggacggggacggagcctggctgccgacctaccagagcgacctgtccgtcgccccgggctggaaggccggcggacacccggcctggaacctcaccgggcccgggaccatggactgcgacgcctgcggatgcccgacggaactgctgctgaccgtcgcgacgaacgaatggcacgcggacacccgcagctggatcccgctcgaggacgggccgcggaacccgaccggggtcgtcgtcggcaaccacggcagactcaacgtcttcgcctgcccccgggacccctcccacccgcacggcttcagcatccagtgaggcggcccggggagtggccggcggatcacggccggacggcccctacctccccatcgccgccaggcccctcgccaggtcctcggcgttcatcaccggagcgacgtcgatctcggcgttgaactgcaggaacaggtcctccatcagcggcggcatctgcgcgctgtcctgcaggtcgaagacgatccagcaggagcgcacgccctcgtgcaggccgaagtaggcggcctccggcttcaccttgtccatcagggtcttgatcgcctggggcagcgcgccggtcttgatgccctcgttggtggcggccgtgtccatgtgcgccctgagcatgactctcatgcgtggctccttccgtcaggcccaccctgggccggggtcgggggcgcggcaacatgtgcgcccccgtccggggagggtccggccccggagctccgggccgtcgggaatccggcccgtcaggcgccctggatgtggaagttgaagtccgcgtggccgagcgcacccatcaggcggagccacacgggcagcagcatctccgtgccccgggccgtctcgatgcccccgaggtcgaggacgctcgcctccggccagccgaagctgtggagcagttcccgcacggccttcttggcgtccgcgtcctcacccgagaggaagacgtggtgctcgccggggacccgcgccggatccaccatgatctggcagttcatcgtgttcagcgtcttgaccacccgcagccgcgggaaggtccgctggatcagctcggccaggctgtcgtcgttgaccgggtccaggaccggcgggaagccccccgagaagtccagcgggttcgcgatgtcgacgaggaccttgccgtcgaggtgggcggcgtccgcctccgtcagggcggcgatgctggcctgcccgccggtcgcgttgaccaggatctcgccgtcccgcgcggcctgcgcgaaggaggccagcccgatcccggggtggtcctggtgccactgcgcgtactcgtcgcggccgacggtggcttccggatccctggtaccgatgacgacctggtggccgaggccgtcgagccgggcggccacggtacggccgacgatcccggtgccgaggactgcgtagcgcattgcggagatccattcgtagaacggaggccgggccgcccgggccgggtcagcccatgatcccgacatcgtagaagaaccggtactgcttcggatgctccggaaggaaccagtggaagccctcctccaggaagaccgcgagcatgctcacggcgatgaccgcccccaggaaccacagcgcgcacatgcccgccgtgcgcagcgcccccgggcggaccgccgggacggcacggtcggccgtcgcgtgggcgaaggccagggcgacgccgatcgcgaccaccgagagctggaagaggatccacgcccagtggtacaggtgcagtccgagcacctcgctcccgtaccccttgtcgcccggcatgacctgcagcatggtctgccgccaggacgtgaaggagcccccgatcgccgcgaccagggacaggccccagcccgtcatgtagacccggggcgtcacggtgccgctgatcagcgccgagcggatgatgtacgccgcgcccagggccgccagcagcatgaacatccgctgcgcgacgcacagcgggcacgggtgctcccccggtccgagctggtggtagagcccggcgcagacgactcccgtccagccgagggcgaagaagcaggcgaaccagtactggacccggcccagcaggccgctctccggcggggcgtccggcacgagggtgtgcatcgtcgcggccacggtcagtagctcagattcagggcgaggccgctggtgaggtggtgcgcggtcagcagggtgacggcgaccagcaccgcccaccacgcgccgagcacgaccgtgcgggacgcgccccggtacagggcgatcagcgtggcgaggagcccgccgaagatcagggtgtccatgccgcggaccgtaccgagacggcgacatcactcctgcgaggcgcgcccccggttacgtcggttgccgcgtcggccgcgcccggcgcgcccggcgccggggccgccgagggtccggccgtccaggccgatccacacccggacctcggtcccgccgaggaccgagcgccccagccgtacgtcgccgccggtcgactcggcgacccgccgcacgatgtccaggccgaggccggtcgacccgtcacggccgccgtcgttgccgcggcgcagggccgcgtccgggtcgtcgatgccgggccccgcgtccgagacgagcacgatgacggcgtcgcccgcgtcgtggacgtccaccgagaagggggtgccctcgggggtgtgccggaagacgttgccgagcatggcgtcgagggcggcggcgagttcgggccgcgccacggggatccgtaccgtacggtccacacccgcgagccgcacctcgcggccctcgtcctccgcgagcgccgaccagaagcccatccggtcgcggatcacctcggaggcgtcgcagcccgcacccgccccggcccccgggccggtggccggacgctgctcccgggcggtacggatgatcgtgtcgacctcgcgctccagctgttccacggcggcccgggtctgttcggcggccgggccgtcgccgagcgaggccgtgttgagccgcagtaccgtcagcggcgtccgcagccggtgcgagaggtcggcggccagctcccgctcgttggcgaggagttcgacgacctggtccgccatcgcgttgaacgcggccgccgccgagcgcagttccttcggcccgtcctcgggcacgcgggcgccgagccggccctcgccgagctggtgcgccgcgtccgcgagccgttcggccggccggaccagcctggcaccgagccggtcggcgaccccgaccgagccgacgatcagggccagcccgacgcccgcgagcaccagccacgccgtggcgacgccgttgctgacctcgctctccggtacgaagatctccaccaccgcgatgtccccggacccgagcgcggtcggctggagcagcgccgagccgccgccggacaccttggccgtcgtggcacgccccatccgccgggtctcggcgacggcgcgctccccggcgcggccccggccgatgtccaccggcgggctgtcaccgatcgcgggcacgtggacggccatccgccgggcggcgcccatctgggtggactcgaccgccttgcgcagctgcacggggtcggtggtgatggacagggtcggtccgatgctggcggcctgccgctcggcgttggagaaggcccggtcgctggccatctcctggacgacgaggccgagcggtacggcgaaggccacgaccaccatggccgtgaccgcgaggcacaccttgacgagcgcccatctcatcgcgcgctcaccggggcggctccagcttgaccccgaccccgcggagcgtgtgcaggtagcgcggccgggcggcggtctcgccgagtttgcggcgcagccaggagaggtggacgtcgatggtctggtcgtccccgtacgactgctgccagacctcggcgagcagttcgcgccgggccacgaccactccgggccgcccggcgaggaaggccagcaggtcgaactcccgccgggtgaggtccagtacggccccgtccagctcggcctggcggcgcagcgggtcgatcgcgagcccgccgacgcgcaggacgcgcgagggcggttcggccccggcggcggcccgggcgcggcgcaggacggctgccatccgggcggagaggtgctccacggagaaaggtttggtcaggtagtcgtcggcgccgtcgttgagcagccggacgatctccgcctcgtcgtcgcgcgcggtggcgatgatcacgggtacgtcggtgatgccgcgcagcatcttgagcgcctcggacccgtccaggtcgggcagtccgaggtcgaggatgaccacgtcgaagcggtggtgcgcgacttcgcgcagggcctccagggccgtgccgacgctccgcacggtgtgcgaggcctcggtcaggtgccggatgagggcggaacgtacgaactggtcgtcctcgaccacgagcacacttgccatggcccgcacggtagtccatccggacgacccggcggggtgtcgggccactcttgtggcgggtggtgcagtatgtgccctgatgcgacgaggacttcttcatgcgatggcctggatgctggcgaccggcgcggcggtgacgctgtcgtggtggggcgtgcacaccgtcatgtcgggaacggcctacgatccaccgctcgcggtacccctggccggccagccgctgtcctcgtcgacgcacagcgcgcagccgtccccctccccctcggcatccgtgtccccgtcgccttccggttcgcccgccccggacgcgtcgccgtccgccggggcctccccggagaagtccccgaagccgttggccacccccggcccgaaccagcggacggaagtccaggacgcggggaaggtgcaggcctatcccgtgtccggcggccgggtcgtcttctccctgggcgcctcttcggccgagctggtctcggcgacgccggcgaccgattggcggatgcaggtgtggaagacggacttctggatccgggtcaccttcaccaaggacggccgcgaggtctcggtcttctgcacctggcacgaccacccgccgctcgtcgagatcgtcgacccctgaggcggcggacgaccgtctagcggaagaccgagggcggcggctgcggcgaggccaccgcggaggcgtccacgaccggggtcgcgccgcccgcgaagtcggccagggcccggccgtgctcgacccggcccgggtgcgggtcgctcgcgacccggcgagtgaactccgctacgggcagctcacggtcggccgccaccaggacggcgttgccgaaccgtttcccccgccacaccaccggatccgcggccagcgccagctccgtgaaccgggacgcggccgtcgcgatctggctccgcagatgggtcagcggcggaccgtccgccagattggccacgtaccacccggtgggcgccagggcacggcgtacgtcgtccaggaactcggtgctcgtcaggtgcgccggggtgcgcgcgccgctgaacacgtccgcgatcaccaggtccgcccagccgtccgggaccttcgccaggcccgcccgcgcgtccacggcccgcacccggacccgcgcctgcgggtccagcggcaggtgttcccgtacgaaggccaccagggcggcgtcgatctccacgacctgctgggtggagcgggggcgggacgcggcggtgtagcgggcgagggtgaaggcgccgccgcccaggtgcaccacgttcaggggctgccgggcgggcgcgacgaggtcgatcaggtggccgatccgccgctggtacgcgaagtccaggtacccgggatcgtccaggtccacatgcgactgcggggcgccgtcgatcagcagggtccaggccccggaccgctcccggtccggctccagctccgcccggccgccgtccacctgcccgacgaccgcctcggcgccgccgcggccgcgctgcttgcccttgttcctgtccttgcctgccaccaccccattgtgcggggcggtggcggccggcagccccaggaccggtcagcggcagttgtccgcggcctcgatcagccgggccgcctcgccgagcgccgcgcgcagcacgtccgggtcggtgaccggcccgacggcctccggcgggagcagccagccggtggcgcccgcggtgggggaggcggcggcgtcgccgaagcgcatgccgcgcccgttggtctgcgtacacgcgctgcccggcaggtcccacgcgtcggcggtgccggacggcacgaggaagccgagggtgtcaccggatccgtcgtgcaggacgggtccgaccccaccggccttgctggcggcacggcggatgatgtccaccgcctccagcccctgccgggtgggaacggtcaccaggtccaggtccggggccgcgccgggctgctcggacgcggtgttcgttccagtgctctccatgccggcctccaccaagggaacccctcctcgatccgtatccgcatgggttcaacgcacggaaacgtcaacgggtgcggtgccaagacgccgcaaaggatggcagttcatggcggatcgcgggtgagatatccgttttgtagccaaacatcgcatgaacaccccctcgctggcggtacgttcatgcgcgccggacccccagtcacagcaccggcactgcgttcctgccagagaggtcacgtccatggcggcgtccccccactcacccaactccacgttccggcggctgcgcgggcagcactccccggccgagttcgcggccctggtgcgccgggccgcgaaggaaatcggagaaacggtttcctgcgacgcgcgctacatcggccgggtcgagtccggcgagatccgctgccccaactacgcctacgagcgggtcttcctccacatgttccccggccgcgcactggccgatctgggcttctcaccccgcgagagcgtccgcggccgcgcggcccagcgcgttccccgaaccccttccagctccaaggagagcgacgtgctgcgtcgcgcgttcatggcgggcggctccgcgaccgtggcggccgcgacgctcagcctcaccctgctcggcgacacccgccggctcccctcccgcgccggcgagtccgaggccgccgccgtcgaggacgcggtacgccagatccgcctgctggacgaccggcacggcgccgacgccctctaccggcgggccgccgaacccctgcgcaccgcctacgcactgctcgacgccggcgccacccggcagtccaccgaggaccggttgcactcgggcgccggcgaactggccgtctcggtcggctggctggcccacgactcgggccgcttcgacgacgcccgctcgcactacgcggaagccctcgcgacggcccgggtcgcgcgggacccgggcctggaggcgcacgccttcagcaacatggccttcctggcccgggactgcggccgctcccgcgaggcggtacgggccgcccaggcgggccgccgcgccgcccggtccctcggttccccgcgactgctgtccctgctcgcgctgcgggaagcgggcggctgggcggggctggccgaccgcaaggcgtgcgaggaggcgctggcccgcgcgcacacggagttctcccggggcgagtcggacgccgaccccgagtggatgtccttcttcgggcaggcggaactggagtcgttggaggcgcgctgctggtcggcgctcggcgaacacgcccgcgcggcccggcacgcccgccgcgccgccgacctccaggacccgcacttcgcccggaacgtggccctgtacaccgccgagctggccggcgacctggcccgcgcgggcgcccccgacgaggccgcgtgggcgggcggccgggtgctggacctcctggcggaggtccagtcgacgcgggtccgctcgatgctgtcggcaacggcccacaccctcatcccccaccagcgctccccccgggtagccgcgttcctgacccgcaggtccccggccgtgtgacctgcggtccgctcggtggtgtggggtacgaccttcccgtgccgcggggtgctcggtggtgtggggtgcggccttcccgtgccgcggggtgcgcctcaagcgccggcggggctgggtggtgtggggcggggccccgcacgagggtctcctcggctcgcgcatgcggccgtggttctgtggctcggcctgggttgcgcgctcgtcctgcggggaccctcctgcgtgtccccgccccacggcagggcttcgacggatgccgcggcggggtggggggacgtggcggggtgtccccgcaggacgagcgcgcaacccaggccgtatgactgggctcccgccgcaggcgcgagccgaggagacatcccggcgcggcaccccgcgccgccccatgccgacaggcccgcatcactcagcctcgccggcgattgaggcgcaccccgggccgggacagcccgagccgcacaccgccgagcaccccgcaggggcacggcctcgccggcgcttgaggcgcacccccggccgggacgacccgcacaccgccgagcaccccgcacgggcacggcaaccccggccgggacgacccgcacacctacgacaggtggcccgtgtcgttccagcgttccagcgcgggtgcgccgtaggcccagcccaggaccgagagggaggtcggctccagccggatccgcgcgccgaaggaggcctcgaagcccagccagcgcgcggccagcgtgcgcaggatgtgcccgtgcgcgaagaccaggacgtcgcgctccgccgcgcgtgcccacgcgaccacctcgtccgcgcgagccgcgacgtcggcgacggtctcgccgcccggaacgccgtcgcgccagatcagccagcccggccggacggcctggatctcggccggggtcatgccctcgtagtcgccgtagtcccattccatcagcgcgtcccacggctcggcccgggcgccgaagcccgccaggtcgcagctctcgctcgcgcgcaccagcgggctggtgcggacctcgacgcccggcaggccccgccacgggtcacgggccagccgctcgccgagcagcttcgcgctctgcctgccctcctccagcatcggcacgtccgtgcgtccggtgtgcttgccgagctgggaccacgccgtctggccgtgtcgggccagcaggatgcggggggccatgtgaattctcccggtcgagtcgagtccgtccaccatcatccatcacaggggcgatgcggggctcccgcggcccgcggcccgtgcccccgcccccaccaccggttttcgcactaagtccacgattgtcagtggcggatgggacacttccgcgggtgagctcctacccgcccgccagccccgcgcagccgacgactctgcggcagcggctcgccggtctgcgcggccccgccgtgccgccccgtccgctcgacgcccgggccctggcggctctcgccgccaatcccggctgcggcagacgcgccctgctcgacggcgccggcgtggacaagaccgccctcgccacggcgctgggcgcccccgcctccttcgggcagtcgcagttcgcgatagtccgcgggaactccttcgaggccaaggtcaagggcgacggcggcgccgagctgctgcggctcgtccacgcgcacctcgcgcccgccgccgagccgccggggcccggcgcccgcgttcccgatctgaccgccgccgggcccgagggccgcgccgcccggaccgcgctcgccctgcgcgaggcgaccgccgccggccgggactccggcgcctggacgctgctggaccatccgatgctcgccctggaggtggccggctcgcccgcctatctggagcccgacgccgtcgtcgtgcaccccgacggccggtggacggtcgtggagatcaagtcgttcccgatgatcgacggggccgcggacgccgcgaaggtgggtgccgcggcccgccaggccgccgtctatgtgctggccctggagaagaccgccgaaaaactgcccggcgccgaggtcgggcacaccgtgctgctggtctgccccaaggacttctccaacctgccggccgcctctcccgtcgatgtccgccgcgagcgttcggtgacccgccgccagctggaccggctgacccgtgtggaggaactggccgccgccctgcccgagggcctcagcttcgacctggcgacccggacccccgaggagctcgcccgggcggtgtccgcggtcgacgccgcctacgcccccgagtgcctggccgcctgcgagctcgccttccactgccgcgaccgggcccgcgccgccgaccaggtcacggcgctgggccggtcggtccggggcgagctgggcgcgctgaccaccgtcgggtccgccctcgcggcggccgccggggcgggctgctccgaggatccgaccgccgccgcgctgcaccgcgccgcccggctgcgcgccgaggccctggaactggccaccgtccgtccgccgcaccccgccccggagacccccgcatgcccctgctgagtaccctggcccggctggaggccgtacgcgcgggccgcgcccagccgctcgcgaccgtgcggcaccgccacctgagcgagcacccgatggtgttcgtgccgctgaccaccgccggtgaggcgggcgctccgctcggcgccatggtcggtaccgaccggcacgcgccgcgggtgttcgtgataccccagccccgcgaccgcgaccggcgctgggccttcctcgcggagctggccgtgcaggtgctggcccacatcgaggcgtacgcggacgcggtggagccggccgagcgcagcgagaccgacccggagacgggcaagcgggtcaaggtcgagaccgagctgtgcgtggacgcgccgcagctgatcgtgccgagccgggcgggcatcgagtacgtacggctgctggggcgctcgatgcgtttccggcgcaccgccgaggaggatccggacaatccgtatccggcgccgtcgcaggtgccgatgctcgggcgctggttcacccacctcgccgagcgttctcgggtgcccggctcctcgatgctgctgtcggccaccgatctgctgtcgcggcactgggccaccggtcagagcagtctggaggaccagcacctgggtgcgctcctgggctggatcgacccgcccgagggccggtcgggtgccgaggcggcgcaccgggccgagctgagccgggacggggacggccagctgctgtgcccgcccgcaggtccggccaccgacccggccttcgacaacaagctgctggctccggccatcgcccgctacgacgccgcgcgcacggtcctggcggccggtcccggggacgacgaccgccacgtccgggcggcggagcgggaggtgcaccggctggtcgagtcccagttgtcggggacctggtggaagacctgggaggcggtcgatctgctgcgggccctgccgccgggtgagcgcgtggaggaacgctggacgcgcgaccgctggtcgtacacgggccaccgggaccgtgtgcgggcgggcgagccgccgcagccgcggcgcgacgacgcggtgacggcggcccagaagctggccacgcgggagaccgaacaggtgcggctcgacgcccaggaggcgctggacgaccctctggtgatggcggggcggcggctcgggggcgaggccttcgtcggtgaggtcaccgaggtggtgatggagtggacggagtcgaagcgtccgagtccgcgcccgctggtgacggtggtgacggaggaccggccgcagctcgccgacgaggggggcgggggcggcgggaaggtgttccgctcgctggacgggcgcccgcagagcgcgcagttcgtccgctacgacggggacgggcaggtggtgctgaggctcctcgacaagatgggccgcggccgggatcccgagccggggtccgtgccggagaagggcgaccggctctgctggacgctcttcgagcacgacgcgcgcggcggcccgaaactcccggagcccgagcagaccccgtggacgcacggcggtccgcccgggtcggcgggcgccgttcccctgcccgattccgtgaccgacgaggacctgctgtgaccacgaccgctcccttcgacccgggtgcggcggccgcccgggcgaccgccgcgatcctggccgacaccctgcacggatccgagcggggcgtggtcgtcgattcccctcccggggccgggaagtccacgctggtggtccgcgcggcccgcgagctggccgcggccggccgccggctgatggtggtggcgcagacgaacgcgcaggtcgacgacctggtgctgcgcctcgccgacaaggacccggagctgaaggtcggccggctgcacagcagtgacggggacgccttcgatccggcgctgcgcgagctgccctcggtcaccctctcggccaagccgaaggacctgctggagctgccgatcaccatttccacggcggccaagtgggctttcgtcaaggatgtcgagccctggcagcacgccatcgtcgacgaggcgtaccagatgcgttcggacgcgctgctggcggtggccgggctgttcgagcgggcgctgttcgtgggtgacccggggcagttggacccgttcagcgtggtcggcgcggagcagtgggcgggcctgtcctacgatccttccgcctcggcggtgagcaccttgctcgcgcacaatccgcaactgccgcagcaccggctgccggtgtcgtggcggctcccggcgacggcggcgccgctggtgtcccgtgccttctacccgtacacgcagttccgcagcggtacgggtccgggcgagcggcggctgtcgtacggggtcgcctcggacgggtcgggcccggaccgggtgctggacgaggcggccgaggcgggctggggcctgctggagctgcccgcgcggcacaccccgcgcacggatccggaggcggtgcgggcggtggccctggtggtccgccgggccctggaccgcggggcggtgacctccgacgagcagtccccggatccggctccgctgacggcggagcggatcgcggtcggtacggcccaccgtgaccaggcggccgcggtccgcgcggcgctggcctcgctcggtgtcacgggggtcacggtggacaccgcgaaccggctccagggccgcgagtacgacctgacggtggtgctgcatccgctgtcgggccgcccggacgcgacggccttccacctggagacgggccggctgtgcgtgctggcgtcccggcaccggcacgcgtgcgtggtggtggcccgggcgggcatagcggagttgctggacgaccatccctcgacggagccggtccagctgggcgtgacggtcaaattcccggacggctgggaggcgaaccattcggtgctggcccatctggcggagcaccgggtgtcctggcggccgtaggggaggtgcgcgcggcccggccgctccttcaccttcaccgtggtcttcaggcactgtgatcttcgggcggatgtggaaccaggaaccccccgatcgcatccttgaacatgttcaagtagacgcgaccagggagttcttcagccatgcccgtacgacgcaagcgcctcaccatgtggctcacgatcaccggcgcgacggcggtagtggccgccggaggctggtgggcgtccctgtggtgggccgctttcacaggcgacttgggcgtgccctgcgacaaggcggcccatttcgcccgcgccgccgaactgcccgcggggacgcgcgaccggaactgcaccacgggccagtggatgagcgcctcgtacgagctggacttccgcgcgccccgccaggaggtggcggcctggctgcgcgcctcctaccccgacacgaagatctcggaggactgctccagcgccgacgcgtgcgggcagccgcaactgcacggccccacgccgttcaaggacgaggacggccaccggctcgcggacggggtgcacgtcgagctcgactacgaggacggaggcgtcgcgcacgtacggatctccggattcaccgtctgagacccgcgggcgcaccaggggcggccgaccggccggttcaggccttgcgccgggcgcccagccgttcgcggagcacctcgccgacctcggccagggtgcgcagctgttccggcgtcagcgcgtcgatcaggtggcggcgcacggactccacgtggagcggggccgcctccgtgatcacggcgacgcccgcgtcagtgaggaccacctccgcgcccctgccgtcggtggccaccccctcgcggcggacggcgccgcgctgctccatgcgggtgagctgatgggacagccggctgcgggaccagcgcatcagctcggcgagtgcgctgacgcgcatgcggtggccgtccgtggagccgagcaccgacaggacgtcgtagtccgcctcggagagcccgctgtcctgtgtgaggtcgcgcgcgatctccgcgttgaccagcgggaacatccgccgccacgcataccaggcgtcctgttcggactcggtgagccagcggggccctggctccggtgcgggggtcatgtccgccactctagccaggtcggtgacacatcacttatctggttgacatgtcagccagatcctcggttttattaggtgacacatcaacaattgcaccgaacggggagtcttcaccatgacccgcctgcacgtcgtctccgccgccacccgccccacctcctccggtcgccccctcgccgcctgggtcaccgagcaggcccgcgagcggggcgacttcgacgtcacctccgtcgacctcgccgagatcgccctgcccttcctcgacgagcccgaatacgcctccaccggcaactacgcgcatcagcacacccgcgactggagcgccctggtcgactcggccgacgccttcctcttcgtcctgccgatgtacaacggcggcttcaccgcccccttcaagaacgccatcgacttcctctacaacgagtggaagggcaagccggtcggcatcgtcagctacagcgccggccccaccggcggcgtcccggccgcagagatgctgctgccgatcctcacccgcctgggcatgctgcccgccgagcactccgtcgcggtcccgggcatccccaagctgctcggccccgagggcttccaggccccggaggcgctcgcgggcgagctcgcccgcgtcctggacgacgtcgccgaactggcggagaagcgcgccgccgaggccgccacggtgtgacccgcgcgccgtcgtcggcgcgggagcgcgccgacgacgggcacgtgggttccggggtgaccgccgaccaccgcccggccgaccgcctgtacgactcccccgtcccccgagtccacccgcctgctcgggcgtcccatcggccgtacgggtgttccagcccgtcgcgcaggggtcttgcgtggcgttggacaatggacggtggcccggaatcacgtcgcacgcgcagcaggaggacacgtatggcagagcccgagcggaccgagcggcggctgcggccggcgcctctgctcttcgagccctcggagtccgtggcggacccggaacacttcttcgacctggagtcgatcgaggacccgcgggagctgctgacccgtgcgaccgaactgacgctggccttccgggccgcgcaggagcgggcggtggagttccaggccctggcggcggcccagctggcggatccccgccggttcgaccggctgtcgccggcgctgatcgccgagcaggcggagtggaccgaggactacgccctcaagatgatcgaattcggcgagaccctccagcgcggcgcgggcacgccgtagggggcctcttgccgatcgggccggaccccgcgagcccggcccgatcggcacgacactccccaggggtccgggtcgcggcgcaccatactccgacggcagctccgctgtcccggtttccggtaactccgggatactacttcgctacggcgggtagacagtggcatatgacgacgctgacgacggctcccggctgcaccgccctccacgcgcgcggcgaacgctctcgcaccgcgcccgccacccacgtcaccccgcagggagccgcctggctcgcctccgcggccgcccagccccggcgcaccctcgcggtgtgggaggcgcggcccgggctgcccgccaccctgccctgcggggatcccttcgacgtcgtcaacgtcccgctcgtcctcgggcgccgcgtcctggacctgctctgggccgagggccccggctccgggccggtcgccgtgcaccgcggccggatgctgctcttcgccgcgcccggcaccgcccaccggctgcccgccctgctggcgtgggaggagtgggggggctcccggaccgccccggcgccgctgtgccacggccgcggcgacgccgtcaccgtgccgccgctggccgccacgcccgggccgtcccggtggctcgtggcccccgacgcgcgcgagccctggcttcccgggcccgaggccctgctctgggccttcgtacgggcggcccgcagccccgcaccgaccggacctggggatatcgatttttcgttccgcggatcctcctgctaatgtcttccacgtcagacaagcgccgctagctcagttggttagagcagctgactcttaatcagcgggtccggggttcgagtccctggcggcgcacagacagaagaaggcccccacgcgagtgggggccttcttcgttgtccgggggcgccccgcggagcgccccgcggtcatgtcgtgatcttcaccgtgtacgcgccggaccgggtgcggtccgccacctcgatggtgatccgctctcccggcacggtgtacgtctcgcccacctccatcggcgcgtccgccagcggcgggtacaccgagcggtcccagcacgcctccgtcgacgggtgcgcgtccaggacctcgatcgggccgccgcccgacgaggcctcgttgcgcacccggtagaccaggacgccctccgtgcaggtgtccccgtcattgccggccgagccccgcgcctcgacggcgatggcgctgccgcggcccgtacggatcaccgcgagccgggtgccgcccgtaccgccgctcggcggcgcctgggccagcggctgcagggtgtgcatcgaggagcccgactgcacgcagtccacctgggaggcgtccagccagcccagcttccatttgtgccaggcgaaaaggtccggggccatgccgaactggctgcccatgacgtcccagtccccgacgtaggtgtcccagtcccccttgccgtccgtgggccggtggtagaggtcgggcaggtcgaagacgtgcccggtctcgtgggcgagaacgttccggtccggcgggtggcgctcgaagacggtgacgatccgccgcagttccgtgccgtccgcgacgatcgggtgctcgaagttgacgaccttcgtggcatcggagtccactccgggcgcgtccgggtcggcgacgaagtagacgacgtcgtacttgcggaagtccacctgggcgtcggcggtggcgaccgcgtcccgcaggtaggacgcccggtccgaggcggcccagtcgcgctttatgccgtacgcggtggacggcttgggcatctgcatccactgcttctgcgggtgcgggaccagccggaaccgcccgtacgaggcctgctcgaagaagtcgctggtggcggggaagtagtcgccgacgatctccccggtcgtcagggcgctgcggtggtcggggaaggagaggaagaccatgacggcgttgagcgtgcgttccggcttggggtaggcgccgttccaggtgtccaggccgagggagtggtgcgccgaggtgcgggtgagcgcgcagggtccggccccggagtcggccaccgcgggaccggcgacgagcgacatggcggcgagcgccgtcagggaggtgagcgccgcggcggtacttcggacgcgggagcgttccactcccccgggtgtctgctgtcgcgccacatcgacctccggtggtggattcgtacctattcatccaccttgaggcgattgtcttactaatgcccagttccgctgccccacatgagtgactaatacggcaagtcggtgaccctcgaacttcacgcctctgcctacagaacgtcacgaccgatcacctgagatcagcggaagcctccgcacgttcagagccgcgcagaaacgatcgcccgacctgacgccgacgcgccgtcatcacggcgaactgaaccgtctcaaccggtggcgccgctggatagggccgtccgccagcctctatgatcggcacactttcctgcgcggacactcacgaacactgcgggagccaacggtgagcggaacctcagaaggaaccggttcggcggccgacagcatccgatcggccattacggagcgtcacccggcagtgccggcagtgccgtcgacttcggccacccaggccacgccggggtcgccgtaccgcgccgactccgacctgcgcgactaccgggccgccttcaacgcggcccacctcgccatggccgtcgtcgaccgcgagggctacgtggtcgccgccaaccaggccttcgccgggctgctcggcagcgaaccccacacgctcgtccaccggtccgccgccgacctggtggacctggccgcggaggcccgtacctgggccgcctaccaggaggtgctccgcggccggcaggcacggctgcgctgcacccgccgcctcaaacaccccgacgggcactccctctggaccgaggtcaccctcggacccgtccccggcaccggggacgtcctgctgtcggtggccgacatcagcgaccgccgcgacctccaggcccggctgcgccacctccagatgcacgacccggtcacacgcctgcccaaccgtgcgctgttcttcgagcggctctccgccgccctggaggcctcctcgtacgaacacgggggcggcaccggccggatcgggctgtgctacctggacctcgacgggttcaaggccgtcaacgacaccctcggccaccgggtcggcgaccggctgctgaccgctgtcgccgcccgcctgacgcagtgcgccgaccagtccggctacgggcgcaccggcggacatctggtcgcacgcctcggcggcgacgagttcgccctcctggtcgaggactccaccggcaccgaacaactcgccgacctggcgcggagcgtgctctccgccgtacaggaacccttcgacctggccgggcagcggctgtcggtctccgcctcgatcggggtcgtggagcgggcggcggccggcacctcggcgaccgggctgatgcaggccgccgacacgaccctgtactgggccaaggcggacggcaaggcccgctggacgctgttcgacccggagcgcaacgcgcaccggatgacccgccaggccctctcctccaccctccggccggccgtggagcggggggagttcgagctggagtaccagccgctggtggacctggagagcggcacggtgcgcggggtcgaggccctggtgcgctggaaccacccgcaattcggcacactcacgccgaatcggttcatcgggatcgccgaagaggacgggtccatcgtccagttggggcagtgggtcctgcggaccgcctgccggcaggcccgccgctggcagatcgagcagcccagcgactcccccgtcttcgtgtcggtgaacgtcgccgtccgccaggtgtgggactcggatctggtgggcgacgtcgcggagatcctcgccgagacgggcctcgccccgcagctgctccagctggagctgacggaatcggcggtgatgggctcggcaggccgtcccctccaggcacttcaggccctcagcgacatgggcgtacggatcgcgatcgacgatttcggcaccggctactcgaacctcgcctacctcagcaggctgcctgtatcagttctgaaactggacggttccttcgtccgtggattccgctacgaggagggcacgcaccccaacccggccgacgagaccatcgtggaagccctggtccagctcgcgcaccggctcggcctgacggtgaccgcggagtgcgtggagaccgccgggcaggccgcacggctgcggcgggtgggctgcgacacgggtcagggctggctctactcgcgggcggtggccccggagcggatcgccgagatgatcggcaccagaccgggcgcggaacacccccgctaaccgttccacttcgccgctttcgggccatctagggcccctatcagcgttggacaagccatatcccccttgtaacgatcttcgggccaaaggttcttgaccaagttccttgatccgtgggggaaagcaccatgaaactcacccgtcccgcactcgccctggccatcggcgcactcgctccggccctgctcctcgccaccccggccctcgccgccggccaggccgcggcggcgcccgccaaggccacggcgatcaccgccggggagtcgccgtacgacaccatgtcggacgccgaactgcgcgccgaggtcaaccgcatcctggccggcaagccgggcaagggcgtcaccagtgcggcccacaaggccctcgccggcaccaccgaggacgtacgcaccttcctgaagaccggcctggcgaaggctcaggacgaggacaacatggtcgccatcctccgcatcctgggcggcaagcccggcaagggcgtgacccgcgaagccaacaaggccctcgacggcaccccggccgaccgcatcgcgttcctcaagaccggcctggcgaaggcccaggacgaggacaacatggtcgccatcctccgcatcctgggcggcaagcccggcaagggcgtgacccgcgaagccaacaaggccctcgacggcaccccggccgaccggaccgcgttcctcaagaccggcctgcgcctggcccaggccgaggacgaccgcgtcgaagccttccgcatcctcgcccgccctggcctcagcgacgccctgcgcgcggcggccgtgaaggcgatcgaaggcaccccggaggagctccggtacttcatcacggtcggccagttccaggtctgagcgtgacaggcgccggcttcgtacgccggccgcattcgggggcgaaggcccttgaccaacttctttgatctatgggggaaaccatcatgaagctcacccgtaccgcactcgccctgaccgtcggcgccctggccccggccctgctcctcgccacgccggccctggccgccggctcggccgccgcccctgccaaggtcgccgcggtcaccgccggggagtcgccgtacgacaccatgtcggaccacgacctgcgcgtcgccgtcggccggatcctggccgccaagccgggcaaggccgtcatccgggaagccaacaaggccctcgacgggaccatcgaggacgtgcgcaccttcctgaagacgggcctggcgatcgcgcaggacgaggacaaccgcgtcgccatcgccacgatctacggcgacccggcctcgggcaaggccgtcaagcgcgaagccatcaaggccttcaccggcaccgccgcagaccgcgccgccttcctgaagaccggtctggcgatcgcccaggacgaggacaaccgcgtcgccatcgccaagatcgtgttcgccaacccggccaccggcaaggccgtcaagcgcgaggccaacaaggccatggacggcaccccggccgaccggaccgccttcctgaagaccggcctgcgtctggcccaggccgaagacgaccgcgtcgccgtgggcgtgatcatggcccgccccggcatcagcgccgccctgtacgcggcggcccagaaggtcgtggacggcaccccggaggagctccgctacttcatcacggtcggccagttccaggtctgacccctgagaccgcggtccgcccccggccactgcccggccggggcggaccgcctacggcagcccccgccgagggggctgccgctccggcgtacggtcagaggctccggacgaacgcggtgaacgcggctgccgtgaccgtgaagaccggcccgccggggttcttggagtcccggacggcgatctggcagggctgtgcggccacctcgacgcagtcgccgccgttggtgctgctgtacgaggccttgcgccaggcggcggtgccgagcggggcgcactcgacgcactcgccgccgttggtgctgctgtacgacgacttacgccacggcacggccgtcaggttcagattggtgcccataccgttcctccattacgcgcgcgatcagaagggccgaggccgctggcgaaagggcatcggcttgcaagcgagcgtatccgacggagcgctccttgatcactttcgcgttggccgtcatatgccctgagtcatagctctccgtgtagaagaggtcgggatcgccatcgaagcgaaggagggtgaacgatcccgtcatgccggtgtgttcaccgacggagaagggcatcacctgaatctgcacccacggcctgtcggcaaagctcaagaggtgggccagctggttgcgcatgacctcacggccgccgacgtttcggtgcagcagcgcctcatccagcaccaccagcagcaccggtggctcctcacgcatcaggatgcgctgacgctccattcgggccgccgcgatctcgtcagcgcggtcgggaaactccacgctcaccagagccttcgcatacgcctccgtctgcagtagcccgtagaccacctgcgcctggaacgtggaaatgaacgtcgcccgggcctccatctcggcgaaagcctggaaccacgtagggagcacgctccgcaggaccaggcccaccaggcgggagaagtgcccgtccgtgccgagggccgcgtccacccgttccgagaagtcgcgcgtcgggacccgcttgccgttctcgatcatgccgatcagggagcccgtgcagaagatgatcgcgccgagctgtgcctgtttcaggcccgcttcttccctcagccggcgcagctcgtagctgtagtagtccagcggcgaggcgctgggatcgatgtcgcgggcctggaccaagggacggtcacccccatgcaaacgcgggtcggggccggattcggcctgcggccgagcgtaacgactcccctacgctccggggtcggaatcgtcagatccggacctcgaccgccgggtaggcctcgacgtagctggcgccgtcggctccgtagtaggtacaggtccgcgcgcagggcctcggcgaggtggggaaagccgccggcctcggggcggacggtcgccgcgtgctgagcgccggcatccccaccggcgagatcgcccgcgcacgcaccctgctgcacggcgtcatcgggcaggtgcaccgccacgaggccgaagggcgggttgcgcccgggtgaaacgcctccgccccgccccgggcgagggggcggggcggaggtgtcgctcggcgcggggtggggggagatcagcaggcgccgaggtccttccagacaccccactcacccgtggtgcccggggtctcgttctgcgtccaccactgggccttgtacttgcggccgttgtgggagacctcgttgccaccggtgtagaccgtgcccgcgacgtacgccggggtcgagccgcagcccgtggtcggcggggtggtcgggggcgtggtgggcggggtcgtgggcggagtggtcggaggcgtcgtcggcggggtggtcggcgggacggtggtgccgccgagggcgtccgagatctggttcagcagcgtggtgttgttgtccaggccgagcagggagtacatcatcgcgccggccaggccgcgctgcttgccgtagtcgacccgggcctggatggacttctggttgaggccggtgaagaactcgccgtccttgtagaagtacgaggccttggcctggtcgtcccagaagctggtcgcggcgttgtcgacgaggccgccgagctccttgtagttggcgataccggcctgctggctggtgggccgggcaccggaggcgccggtcgcggactgggcgaggccgttgttcgccccggcggggacgcccttccagccgcggtagtagaactcgtagcccagcgtcagcttgttggcggggaagccgccggtgatgccgtaggccgggttgccgtcgatccaggagtcgatcgcgttgtcgatgctgtacttctgggtgcccggcgcgatcgggtcggtcgggtcgcccgccggggagtacagcggggactggtggtacgtcgggccgtcactgtcccaggcgccgtgcatgtcgtacgtcatgatgttcgcgtagtcgaggtacgcgccgatcttgtccgtctcgatgtacttgatcttgtcctggccggccgggagcgccgaggtcagcatgtacttcttgccgccgttggcctggccgtaggcgtcgagctgctcgcggaactccttgagcaggagcgtgaagttctgcttgtcctcgggggcgtagtggttgccgaggtggccgccggacgagcccgggtactcccagtcgatgtcgatgccgtcgaagatgccggccgcgacgccctggccgccgtaaccgccctcgaccgggaggttgcccttgatgtactggtcgatgcaggaggagacgagcttcttgcgggaggcgtcggtcttcgccgcgtcgctgaagtacttggagtaggtccagccgcccagcgagatgttgatcttcaggtgggggtacttggccttcagctgcttgaactggttgaagacgccgacgatcggctggtcccacttgtcggcgaccccgctgacgctgtccgcggcgctgaaggacttctggtagtcggcgtacgagtcgcccgcgccgtccccggcgttggggttgttgtcgtcgcccgccgccttgttcgcctcgaaacaggtgaggttggtggggtggatgttgccgaacgagtagttgatgacgtccagcttgcccgctattccacgcgtgtcgaggtgcttggggtagaaggcgttgccgtacacgctccactggtcgtagtaggcgatacggacgccgcccgccgcggcgccggccgaggcgtcggcggcctgggcggtgccgagtcccgcgaaggaggccagcgctccggcggccagcgcggccgtggcggcggcagcgatgagaggtttacggatgtgcatgagctgtctccgtgggggtgggaggggagatcaagcggttcgggtgagagaagtgatagcgatcactccacccccgcgtcaatggttcggaccaaagaaggactagaccactcccgcgctatttccccaagtcagagacttgagcgcacaccagaaaccgctcgccaccccgggtgacgagcggtttaaggctgccttcaggcagctccgcgcaaggtttcggcaacaaaccagccaaacgccgttcgcacaccgtcaatcggcggggggcgcctccaccggcatgccgtacgcatccgcgacgagctcgtaggagcgcaaccgggccgccccactgtgggcgttggcggtgagcatcagctcgtccgcgcccgtcagcttcgccagatcgtccagcccggtgcggacctcgtcggacgtgccgtggacgacgttcgcgagccagccgtccacgaactcccgctcctgcggggcgaagtcgtacgccgccgcttcctccggtgtcgggatcaggccgggccgtccggtgcgcaggcgcagcatcgacagcgcccccgtcagcacctgggcgcgggcctgcgcctcggtgtcggcggcgagcgccgagacgccgatgacggcgtagggggcgtcgaggacggccgaggggcggaagctccggcggtagaggtcgagcgcgggcagggtgcccgccgccgagaagtggtgggcgtaggcgaagggcaggccgagttcgcccgcgaggcgggcgctgaagccggaggagccgagcagccacagcggcggccggccggtggggccctggaccgggcccggtacggcgtgcacgcgggcgtacggatgcccgtcggggaagtcgtcgtcgaggaagcgggtgagctccgcgagccttcgggggaactcgtccgcggcctcgtcgaggcgcccgggtccgcgcagcgccgcggcggtgcggccgtcggtgcccggggcgcggccgagtccgaggtcgatccggcccggggcgagcgcctccagggtgccgaactgctcggcgacggcgagcggggcgtggttgggcagcatgaccccgccggaaccgagccggatgcgggaggtgtgcgcggcgaggtgcgccaggatcacggcgggcgaggagctggcgacgccgggcatggagtggtgctcggcgacccagtggcggtggtagccgcgggactcggcgaggcgggcgatctcgacgctcgtacggagggaggcgtgggcggtgctgccggcaccgaccgtgacgaggtccaggacggagagcggtacggtcgcccggccccgggcggtggcgcggatcccgttcacgttccggttcgccccgccgcccccgctcgcgccgccctgcacgtcgtcccctgcgtcactcatcgtcgctcccgtttcgttctcccgtgcgtacgacatcagtgcgacaccgtacgaagacttcgaaccgtgggcggccgccgcgcattcccggtggatcggggtggcgcgcatgccactggcatatgccagtggagtagatccaggcagacagtcatgattgagccagcaatctctccaacaggcgctccacatgcgcctcttgatggctatcgtggtagggcaagcggtaacaacctgctagggggaaaccgtggcgctgaagcccgagccgaccgcgccgttccactcggtgcagtacgcactgcgcgtactcgaaacgatcgcgcgtcacaccggtggtgtgacggacgtgcagatcgcgcgtgagaccggcctgcccgcagcccatctcgctccgatgctgctcatgctgcgccgggagggatatgtcctgcaggtgtccgacggcgcctacgccataggggattccctcgtcctgctcggctccggcatcgaccggcagcaggcgctgaccgacaagctccaggagaccctggaccggctgcgcgactcggtcggcgcggccgtgtacatcagccggtacgtggacggcgaggtcaggatcacacagttcgcggacagtccccgcaccccgaaggtgcacgagtgggtcgacttccgctccgccgcgcacgccagtgcggtcggcaagtgtctgctgacgcagctcgacctgaacgggcggcgtgaccacctgtcccggcacaagatcgcccggctcacgtcgaagacgatcgtgaacgagcggatcctgttctcgaagctggacgcccagcccgccaccgtacccatgctggacctgcaggaatacgccgtgggcacggtctgcgcggcggtgccgatcacagccggggcctcggtgggctgcctggccctgtcgatgccggtcgagcacgcgcaccggcttcgggccgctgcggacaccctgaaccggaaggccgcgccgctgctgctgtcgctcacgctgtgaggtgggagagcggacggcgccggtgacgccagtgacgccgacgggcccggaaaacacttcgggcggttcccggtgagaccggaaaccgcccgaaggacaggtgcgccgccagggactcgaaccccggacccgctgattaagagtcagctgctctaaccaactgagctagcggcgcctgctgacagagaaaatactacccggtcctcaggggtgctcaaaaccatggcccgcggaggtacgcggagagccgctcgcggggagcgggcagggcgcggccgagggcggcgccggcctacccccgctcggcgcgcggccccgcggggacgtgcggggacgtgcggggacgtgcggggacgtgcggggcgacccgaccgcaccgggcacaggaagtcgggtccggcacagtggaacctccctagcgtggagatcggcaagggaaggacggccacacgtgctggagcggctgaatcaggccatggaccacatcgaggagcacctcgacgagcccgtcgacaccgctgagctggcgcgtatcgccatgacgtcggagtaccacttccggcggatgttctccgcactggcgggcatcccgctctccgagtacgtccgccgacggcggctgacgctcgcgggggccgaggtgctcgccgggcggcggacgctgctcgatgtcgcggtgcggtacgggtacggctcgggcgaggcgttcgcgcgggcttttcgcgccatgcacggggtcggccccggcgaggcgcggcggacgggtgcggcgctgcactcccagccccggatgtccttccggttgatcgtcgaagggagaagcagcatgcgctaccgggtggtggagaaggacggtttcaggctcgtgggcagggggacacgggtcccgctggtctacgaggggatgaacccggccatcgtggagttcgtcaaaagcatcggcagggagacgctggagcggtgggaggcatgcgcgtccggggagccgggcggtgtcctggccgtggtcggcaaccactccgcgcaggacgccgaaggcaccgaactcgactacttccacggggtgacgagcgacgaggacgtgccgggggcttcggagagcctcgacgtcgcgccggggacgtgggcggtgttcgagtcctcgggtgagttcccgctggcggtccagtacctgtggcgggacgtgtacacgcagtggttcccgtcgaacccgtaccggagccgcccgggtccgtcgctctcgcgcacgcgggtgtcgcaggacggcacgcacgcggacgcggagctgtggatcccggtggtgcgggcgggcgactgagccccgacggggtcacgtcccgctcgcggcctcggcgtccccggcgtccccggcgcccggccggtcgttccgggcggggggtgtccccggacgtcgcagcaggccggagcggccctggacctcgtaggtcgcgaggagggcggccagggcggcttcgtccagggggcggtagcacccggccggggtgcggtgccagaccgggtcgtcgcagtggaagccctcgcggcggagggagacccggtggatcttgttcgtcgccgtggtcggcatggccgtgacgacgcggacgtagcgcggggccatcttcgtgccgaggtcctgctggagggagaggaaggccgcgaaggcggccgggtcgaaggccgcgccctcccggagggcgagggccgccatgacctggtctcccgccacctcgtccgggacggcgtagacggcgaccgccgccgcgccctcccagcgggccaggatgttctcgatcaccgccgcggcgaggttctcgctgtcgacgcgcagccggtcgtcggtgcggcccgcgaagtagaggtagcccgcctcgtcgcggaagaagaggtcccccgtccagtaccagccgtcgcgggtgcggtcggcctccgcgccggggttgcgccagtagccctcgaagaggctccggccccggttgaccagttcgccgatcgccgccgagccgttgagcaggcgcccgtcggggtcgaggacggcgggcgggcattccgcgccggtggccgggtcgatcaccgccaggtcgtcgcccgcgcccgcccggcccagggcgcccggcggggtgtccggggtgcgctggacggaggcgccgccctcggtggctccgtagccctccaccagccggacgccgaagcgctcggcgaagcgggccgcgtccaccgccccggcctcggtgccgaagccgagccgcagggggtgggagcggtcgtcggggcggggttcggtggccaggaggtactggatcgcccgcccgacgtaggtgaagtacgtggccccgtaggcccgtacgtcgtccaggaacgcggaggccgagaagcggcggcgcagcgccaccggggcccctccgacgagcgccggcagccagtcggcgatgacggcgttgccgtggaagagcggcatgcagatgtagtggacgtcgtccggggtgacggtgaactggcgggccagcgcggctccggcggccgcgaggcggccctggctgcagatggcggccttgggggcgccggtggagccggaggtgaagtagaggaggaggcgggaatccgggccgggggtccgcagtgcggcctcgccgggcttggcggccgcgtagggggcgagcagggcctcgtactcctcggtgccggtgaccaggatgcgtacgccgggcaggtcgaggccgcgcagcagcggcaggtgggcgcgctcggtgaccaggatccggcagtcggtgtgcaggatgtcgcgggccagctcggggccgcgccgggtggggttgatcccggcgacggcggccccggcgagggccgccgcgccgagccagaacgggaactcgggcgtgttgtcgagcaggaccccgaggtgcggctcggcccccgggggcatgaggtcgacgaggagcgcggcgcgcgcggcggcctcctgggcggtccggtgacgggtgaggacgtgccgttcggcgtcgtcctcgtacatcagcccgggccggtgctcgccccattggcgcgctatgagctccgcgacggtttcgggtgcagtcgtcgtccgcatgccgccggagggtagctgacgtatcgtcagaattgaacgtcggagcaggcgtagaaggccatcggggtgtcgttgacggtccagacggccaggatcaggtgccggccggtcttcccgctcggcatggcgccctggtggacggtggtcatggcggggcgggcgccgttgtaggcgacggcgaggaagggctggggttcgaggtcggcgcgggtgagggccttggtgccggtccagccgtccttggtgacgtagtacttgaagtcggtggtggagtggttggcggtgaactgccaccggaaggagtagctctgcccgctggtcaccttggtggtgggccaggcgccgccgcgcgggttgtcgagctcggagaactgggagagcccgccggaacatatcttgccgtcggcgggaccggccgccgggaaccccttgaagccctcgacgctctgcggttcccactggatcgcgccgcagtcggagacggtccggttggcgcagagcttctggcggctgatcggggtgtcggtgtagccgtggctgctggcggtgggggcgctgacgagggtgatcccggcgacgaggccgaggccgagcgcggcgacgccggcccgcctggggattccgggcatgcggatgggacgcatgatgctccttgaacgtggggggagttcggtgagagcgcgcgcgtgtggggattaggtctagaccaagtcccagattattgacgagagttggccatgtccataccaatgggaaaacgggtggtccgttaccttccggccacccgttctcccgcgctcccgcgctcccggccccgccggaccccctactcggcgcggcccgtgtagaaggcgaccgtgaggtccttcaccagcgccttgcgctcgtagtcgtcgagctcgaccagcccacgggaggtcagccggtggacggtgtcgtccacggcgtccacgaccgaggtcagcacggtgtcccggtgcttggcgtcgatcgcggcgaccctgcggcggcgcatggcctcggccacctcggccgcgtactcgatccgcgtcggctgggccgagaacacctcgatcccgaccgcctcggtctcggccgccagcatccgggtcagcgcgtcaccgaccgcctcggcgtcgcgcagggtcggggcgtcctcgtggaaggcgtcggcgggcagctgcgacagcacgcgggccatcgccgattcgacctgctcggcgaggtactccgtgtggtcctcgacggcgagggtggcgcgtgcggtgtccctgacctgccagacgacctggaccacgacctggagggcgaggccgcccgagtccacggcgggcatcgggtcgctgcgccagtgccgcaggcgtacgtcgatccggcggcgcaggagcaggggactcacccaggtcaggccggtacgccggaccgtgccgcggtagcggccgaagagggtgagcacccaggcgtggccggtgcgggaccggccgagtccgccgagcgacacgagggcgacgatgccgaggaaggcgagcggcggccagtgggtggcgcgcaggccgtggtaggcgcggggggcagcgccgaaggcggccacgaagggggcggggacgaccccggcccgccagagcacggccacgcagccggcgagggcgatcccgccgacggccactccgacccagccgggcagcaccgggccgcggtgctcccggagccggtcgtcgccgcgcgggacccggcggccgggggcggggcgcggggcacgggcggcgcacgcggtggccgcggatgcgggggccggggcgggggcgggggccgccggaagctgctgcgtaccgcggaacgggaggtgcaccggcacctgcgtgaccgacgcgccccgctgggcggctccggggcgcggcaggtccggcgcggcggcgccctcgtccaggccgcgggccaccgcctgggcgacgatctcgaccggtccgggcccggggataccggagtgcggtgccgcggcctcgggccctgattcgggctcgggctcgggctcgggctcgaaggcggccatcggttcgggctcggggatgccgaagtgcggcggcggcgccgcgtccacgggagcgggctcgggctcggccaccgcttcggcctcggccccggccccggcggtccgcaggcgcagggtggccaccccggcggggggctccgcgtcctgcgggtgcgggatgtccaggctcacggcggccgccgggtcggtggcgccctggtccccctcgtcgtacgggtgggcccgggccgccggcacctcccagccgtgcggcggctcgggcgccgggcgggcgggcggcgccgcggcccagccgaacgaggtctcggcggcgacggcgtgctccgccgcggccgggctgcccaccagggccggcggcgggcccggcgggacggcctcgcgcggcaccgcgacggccacggccgcgtgcaccggctccagtgcgggcgcgggcaccggctgcgcggcccactcggaatgaggcgcggaagcgggctccgggacgggcacgggcatcggatccggcgcggggacgggggccggggcaggggcgggcgtcggcaccggctgcgcggcccccacggaacggggcgcgggtgcggaagcgggctccggcgccggggcggaggcgggcgcgggtgtggggtccgcccggaccgccgccggagcggccgccggcggcacgcggagggtgcccgtcgtcgaagtggtgcgcgtggggaacatcgttacctccgtcatgcgaacagccggcgccaggtttccgggcccgggtagccgttggccgaggccccggtccagccctgcgcgcgctggaaggcctcgacgttgcggcggtcggcctcgctccagcgcaggcccggaccggatgtgtagtacttgccgaagcccttcttcaccagctgacggccgagggccctgatggcctcgtgcgactggcccgcgcggaacaccgcggcgcccgggtaggcccgtacgccgcccggtcccggcgcggcagcgaccgtcggcgggatgttcttgccctgcttctcgacgagcagcttccaggtgtgcgcgcccggaatgccgtcggcgtccgcgcccgtccagccctgcgcgcgctggaaggcggcggtggcgagcttgtcgtggtcgctccacgtccggtcggccacccccttggggtagaaccggtacgcgccgcgctcgatcagcatccggccgagctgggccacatggtcgttggtggcgccggggccgaacttgtccgcgccggggaagaccgtcgcgtcccccggcttggagcccgccggcggctgggcgtccggggcttccggcaggatgccggcgggcaccccgttgaaccggtacgggacgtacttcgtcgcgttgctccagtacccgtagggcgtggccagcttccgcgtgttcgggcgcgtctgctcgtaggcgacgtagtgcgtgtgcgtcgagtcgacccagccgccgaagatgaccacgtgcgagccgttgttggggtccgccgggttgtggaagaggagcatgtcccccggcagcagctcatccttggtgatcttggtggcgaacttgtcgaggctgccggtccattcgttcgagccgaggttccagaccatggagacgtagcccgagcagtcctgccggtacccgtccgtccagtactcggacatgctgtacgggacctccgcgtccagccacagcttcgcccggttgatgatcgtcgcgcggtcgatccgccgtaccgcgccgggcttggcgggagcgccgggcttgcccaccggcccgcccttcgggccgtgcagcggggtccgggcaccctgcggggagctcgggtcgtccagggccgccggccccggccccgggacaggggtggccacggccaccgcggtcgcactgccgccgcccaggaccactcccgcggcggtggccagcaccagcgcccggcgggcgccgcgtacggccgggtgccccccgtcccggagcggtatggcccgcgcgcgggcgagggcgcggcggcgctgggcgcagccccggcacacgcagtcgcccgcgggctcgtactcctcgaaaccgggcatcggcatctgcacatgcgtcggaggctgcatcgtcatgcggttccgtccactcccctgctcgtccactcgtccactggtccactggtcgaccggagccgcacctgataaagcatcagatgcggcacgcgcagacatatcgtgcacgataaacccgtcaaacatgggttaatcggacaaggcgggcgtggctggtcacgggcacccctggaggtggggtagagttttccctgtcagcaagcgccgctagctcagttggttagagcagctgactcttaatcagcgggtccggggttcgagtccctggcggcgcacagacggaggaagcccctcgcagcgaaagctgcggggggcttcttcgttctccgctcaggcggcggtaccgggcgcgcccgggcgggctcccacgcccgtcaggtaggcggagaccaccacgttcgccgtgtactccttggccgccttgtcgtaggagcccccgcaggtcacgagccgcagctccgcgcggccccgcacccgctggccgtaggccttgtgcgcgtcgaaggccgcgcgctcgtagacccgtacgtcctcgaccgtgaactcggcgaccgaaccgtccgtccgcaccacccgtaccttgtcgcccggctgcgccgtgctcaggccgtagaacaccgccggcttggaccgggtgtccacgtgccccaccatcagcgccgtcccggccgttcccggctgggctccccggccccaccagcccaccgtgcccggctggtcgtacgggggcggctcgatggccccgtccttgtccaggtcccgggatatcaccggagcctggatgcctatggagggcacgtcgacgcgctggggcggggccgcggcaagcggggcgtgcgcggccggcagccccggacccaccgacccgccggcctgaccggcgggcggggccggcgccacggtgagctggcggccccacagccacaggccgagcaccagcaccgcccaggcggtgaaggtcagcagccggccgccggcggagcccttgtcctcactcaccggccttcaccggcctcactcaccgctgcggcggcggcgcagggccagcgcccggcccgcgacggccagggtggcgaccgcggcgaggacggcgccgatcaccgtgtgcggcagtcccggaccgccggtgccatgggccttcttggccgactgcgccgcgagctcggcggacatgccgccgccgcccgcgtggaccggccagacgggcgtggcgtggtgggacgggcggtactcggagatctggacggagccgctgaccttctcgtggccgtcgcacatcacccggacggagtgccagccgggcgaggcgtgcgagctgatcatcgcgtcgccgtagagcgggctgcggccgccgtcccggccgtagaggtcgacgtccgacacgaaggcggcggacttggccgctccgcggttgccgtcacagccctggacgcgcagcttgacctgcgctccggggtgagccggattcgggtcgaccgtgacgctgccgcggtcaccgcggtcaccgcggtcctcctcgcccgcgagggcgatcggcgcggtcaccaccgagaatgccgccagggcgacggccatcgcggtggcgcggacagcgatcggaacactgcgcatggtgaacctcctcgacaaggagattcacgcgcggcgcgccgccgcgcatccggagcggcgccgtacgtgtcagccgtacgccccaaacgcggtacgcccgtccggccgtacgccggtgggcggtgggcggcgtcagacgaggtcgaccaggtccgcgatcgaggcgaccgtcctggtggggcggaacgggaacttctccgtgtcctgctcggtggtcaggccggtgaggacgaggaaggtctgcatgcccgcctccagaccggccagcacgtcggtgtccatccggtcgccgatcatcgcgctggtctcggagtgcgcgccgatggcgttcaggccggtacgcatcatcagcgggttcggcttcccggcgaagtacggcttcttgccggtggccttggtgatcagcgcggcgacggcgccggtggccgggagcgggccctcggtggaggggccggtctcgtcggggttggtgcagatgaagcgcgcgcccgcgttgatcaggcggaccgccttggtcatcgcctcgaagctgtacgtccgggtctcgcccaggacgacgtagtcgggctcgtggtcggtcaggatgtagccgatgtcgtggagggccgtggtcaggccggcctcgccgatgacgtacgccgtgccgccggggcgctggtcgtcgaggaacttcgcggtggccagcgccgaggtccagatgttctcgacggggacgtcgaggcccatccggtgcagccgggcctggaggtcgcggggggtgtagatcgagttgttggtcagcaccaggaagggcttgccggactcgcgcagccgcttgatgaaggcatcggcgccggggatcggggtgccctcgtggatgaggaccccgtccatgtcggtgagccaggattcgatcggcttgcgctctgccactggactgttctccgctctcggtgacctgcgacctctggtctctaccaccctatcggggccgggccgtggacgtcctgggcgtccacagcccggacccggaccacggggaagggtcagcccaggcggacgttgtcgacggtccagaaccagttgttgtcgccgctgtagcggaaacggacctggacgtcggtggcgccggccggaacctggagggcgagggactcggccttggcgaccgcgtcggcggtgtaggtcttcaccacggtcggggcggcgccgctgtaggagaccaggacctgggcggtctgaccggcctcgtggcggtagtgggtctggaaggtcagggtgcgcgtactgccgcccgcgaccgtccacttgggggtgacgagggtggagtcgaaggtgccggtgtggctcttgtcgtcccactcgtcggagtcggcgacggcgaagacgtcacgggagcggacgttcagctcgcgccactggtcgcgctgcgactggctccagaactcgtcggtcgcgaacgcccagccggcccactcggtgacaccgcccgcgcccatcctggagttgtcgacggaccagccggcgggcggggtgtgcgtgaagcccttcaccgcggccgggatgcccgtctcgtccacccgggccaggaggttcgggcgcagcgtgtcgaacgggtcgtcgtccggggcgttcagcgggacgccgtcgaggccggagccgctcacgccgacctgggcgagcgcggtggccgcgacgtcggtcagccgcacgtcggcgcgtacggagccggccgggatgcccgcgcccttggcgatgacgaaggtgccgcgctcctggatggtcgagccgccgtggccgccggagtcggtgtggccgtggtcggtggtgaccaggatcttccagttctcctgggcgtacgtcgggcggttcttgacggcggtcaggagctggccgaccagggtgtcgacgcgggcgacggtgtcgaggtactgctggctggcggcgccgtaggcgtggccggccgcgtcgatctcgccgaggtagacgaaggcggcgtccgggttctggccctgcagttcggcggcggcggccgcggcgatcttcgggtcctcggtgcggtagccgtcgcggtcgcccttgagggagaggcgcttgtcgaccttcgaggagaagatcgggccgttctggtcggtggaggtgacgggctcccagtcggcggccgcgtatgtgttgagcgccggcctggcgttctcgatgcgggtcaggaagtccgggtgggcggtgtagttcttgccggtgaaggagttgtccttcacgccgtgcttgtcgggccagaccccggtggcgatggtggaccagccggggcccgaggaggtggcggccatcgggccggcgtagagggtgctgcgggcggtcagcccctgggccatcaggccgttcaggtggggcgcggcggcggccttgacgcggtccaggacggcgccgtcgatcccgatgacgaggaccttgtcggtgttggccgccgcggcggcgggagcggcgccggcgggagcggccgcggcggtggcggcgatcagggcggaggtgacggcggtcgcggcgagggcgcgacgtccgggcaggacaggggacacgtactcctcctgggagcaagtgagcggcgaaaggtgcggggaaacgagcgaggaagggcgcgggggcgagaggcggggccggaccgaaggtgcggtcttcggtccagacccgttacgcaagggtcactctgccggtcgggggtggccgggaagtgaccggtcagctgccggtcgccgacttccacgcgtcgacgtagccggtgaggttcttgtcgatgtcggcccagtccggctcgaagatctccacgcccgtcatgatcttggtgagttcgacggcgttggcgtcggtcggcttgacgtcggtgcgcgccgggaagccgccgccgaccccgctgacctgctgctgggcctcctcgctgaggaggaagtcgaggagcttcctgccgttctcggtgtgcggggccttgtcgaccagaccggccgcgtacggcagcgcgaagctggtgggccggccgccctccttcgccgggaaccagatgcccaggttcggcatggacttggactgcgcgaagttcatctggacgtcgccgttggccacgagcagctcgcccttgtcggtcttgggcgcgagcttgctggtggaggaggacgggccgacgttgttggcctgcagcttcttcaggtactccatcgccggctccttgccgccgaagtcgtgcatcgacttgatgagcacggccgtaccgtcgcccgcgacacccggggtggagtactgcagtttgcccttgtacttggcctccagcagctcctcccaggtcttgggggcctcggcgagctccttcttgttgtagacgaatccgaagtagttcttgacgaccgaggtccacttgccgtcggcggccttgtccgcgccgttgaccttgtcggagccctgcggccggtaggactgcagcaggcccttcccgtcggcctgctggatgaagggcggcagggtgatcagtacgtccgcctgggtgttggtcctctcgcggacggcgcgctgcaccatctcgcccgagccgccctcgacgtacttgacctcgatgccggtcttcttcgtgaagtcggcgaacaccttgtcgtaccagccgtcgcccttctcgctcttgaggccgtcggcactgtagacggtgacgaccttcccgccgccctcggagtcggcggcggagtccccgccgcaggcggtgagggaggaggcgagggcgagggtgccggtgacggcggtggcggtgcgcgggagtctcttcgcggtcatggaacttccttacagggaaagggagtcagcggggaaatgaggcggtgcgcggtaggggggtcggcggtcggcgcgttcagcggtacgaggccttggtacggacgcgggagacggccaggaggaccagcagggtggtggccatcaggaccacggcgacggcggatccgccgaagagcgaaccgcggtcggtggcggtgaagacgcggacgggcaggggcatccagtccggcgggtagagcatcatcgtggcactcaactcgcccatggacagggcgaagcagaggccggccgcggccgtgagggacggcagcaggagggggagcctgacccgccacagcacgtacgcgggacgggcgcccagggaggcggccgcctgctcgtacgcggggtcgagccgtacgatcgccgccgagaccgactggtgggcgaacgccgtgacaaggatcgtgtgcgccaggatgacgatcgagctggtgccgttgagcaggaccggcggccggctgaaggcgacgagcacggcgaggccgacgaccacggacggcacggcgacgggcagcacgaacagcgcgtcgatgatccgtttgccgcgcttcctcagcgtggccgcggcgagcgcggcccaggtgccgacggcgagcgcgaggaggctggcggcgagggcggtgaccaggctggtggtcagggcctggagggactcgccgcgcacggcggccgcgtagttcccggtggtcggaccggaggggaaggccccggaccagtgggtggcgaaggaggccgcgaccacgacgagcaggggcagggcgaacagtggcaggaagaggaggccgaagagggcccaggcggcccagcggccgctcttgctatgcaccagcacgcttgcccaccacccggtagaggccgaacaggccgacggatatagcgatgttgacgacggcgaccacgcaggcggccgagtagtcggattcgaggatggccttgccgtagatgagcatcgggagggtcgtgacgtccttggcgccggtgaacaggacgatcccgaactcgttcaggcacatgaccaggacgaggctgccgcccgcggcgagggccgggagggcctcgggcaggatcacctgccggacgatccgggcgggccgggctccgaggccggcggcgacctccagctgggcggtgtccagctgggagaaggcggcgagcagcgggcgcatcacgaagggcgtgaagtacgtgatctccgcgagcaggacgccccacggggtggtcaggaagtggaagggtccctcggcggcgccggtgaggtcggtgacgaggccgttggccatgccgaccgttccgtagacgaagaggagggcgagggtgatgaggaaggaggggaaggagaggaagacgtcgatgaacttggcgacggcgcgggccccggggaagggcacgaaggcgatgaccagtgcgagcgcgaagccgagtacgaggcagccggcggtggcaccgacggccagccagacggtggtcccgagagcttcgcggaagctctgcgaggcgaagacggcggagtaggtgtcgaaggccccgccgccgttgtcggggctgagcgactgctggacgacgagcgcgagcggatacaggaacaccaccccgagcacggcaacgggcggcacagcccacaccccccgcggcaccttgcccctcggctcccttggccccgccggccccgccggccgcgccagccccgccggcgttcgaggcgcggggtccgggccggagccccggggttgggccgggacggcacgggcctgcggcggggcgtcaggcacgggacacccccgcccccaacagcaccgcatcccgcggctcgaagtgcagcgtgacccggtcccccagcgggggcgtctcccgcagctcgggaaggtccgccttcacccggtggccgcctacgtccacgtacagccggtgcgtcgagccgcgccactggacctcggcgagggtgccgctcagcgcgttggggccggcatcgtgaccggggccggcgccgaggccgaacacgtgcggccgtacgcacagcgtggccgtggagcccggcgccgcgcgcccgcgatcgagcgtcagcgtccggccctcgaagaccgcgccgtgctcggccaccgtcaccggcagcagattcgcgttgccgacgaacgacgccgtgaactcggtgcgcggcgcccggtacagctcctgcggggtcccgcagtcctgcagccgggccttgtccatgacggcgatgcggtcggccagcgtgagcgcctccacctggtcgtgggtgacgtacagaatcgatacgtcgggcagctcgcggtgcagccgggccagctcggtgagcatcccggagcgcagctgcgcgtcgagtgcggacagcggctcgtcgagcaggagcaccccggggcggatcgccagcgcgcgggcgatggccacgcgctgctgctggccgccggagagctcgcgcgggtagcgccgtgcgtaggccgccatgccggtcatctccagcgcctcggcgacccgccccgggatcccggccttcccggccttctgcgccttgaggccgaaggcgacgttgtcctcgacccgcatgtgcgggaagagcgcgtactgctggacgaccatgccgatgccgcgcttgtgcggcgggagcgcggtgacgtcccggccgccgatcagcacccgccccgcgacgggccgtacgaaaccggcgacggcgcgcagggccgtggtcttgcccgaaccggaggggccgagcagggccatcacctcgcccggctcgacggtgaggtcgaggcggtccaggacggtgttgccgccgtaggcgacgctgaccccgtcgaaacggataccgctcacgacgactccacgaggagggccgggagtccggctacggagtccaggacgtgggtggcgccgttcccggtgagcgccgcgcggtcgtgggcgccggtgaggacgcccgcgacgatgcccgcgccggcgcggcggccgctcatcatgtcgtaggcggtgtcgcccgcgaccacgacgtcgcgtacgtcggccacggcgccggtccgcaggaacgcggtcagcaccatgtccgggtaggggcggccgcggccgcccgcgtccgcggggcagagggtgaggtcggcgaggtcctgccagccgagggcgtcgaggatggcgtcctgggtgacgcgggcgaagccggtggtcaggacgacggtacggccgtcggcgcggagctgctcgatcgcggcgcgggctccggggagcggggtgacgaggccgccgtcgacgagtgcgccgtaggccgcctcgaaggcggagttggcgcgccgggcgagctcctccgtaccgaagaggtggcggaagaccgagatcttggactcgcccatggtgtcgaggacgtaccggagcttctcggcgtggtcgggggtgccgggttcgacgccgaggcgctcggcggcctgctcgaaggcgcgctcgacgaggccgccgtcggcgacggtggttccggccatgtcgaggacgaccaacttgcgtcgggtgacgtcggtttcggaggtgatgtcgctcatctgacttaccagcccagttcgttcgcggtggtctcggctatggcgggcgagcaggtcatgccgcgtccgccgggtccggtcaccagccagacgccgtcggccacctgctggcggtggacgacgcgggtggtgtcggcgcattgcgcgtacacgcctgcccagcggcggcggatcctcggcagcgggcggccgaggaaggactcggccacggcggcgacgtgctcgtaggggtcttcgagggtgtcgaaggcgaaggggtgctcgtactcgtgggtgtcgccgatggtcagtccgccgtcctggcgctggaccatcagcagctgcatcttgtgctcggcggcgaccggcacctgctcctgctcggcgttgagggtgtcgagcgcgggggacttgtaggcggggtagtagcggaagctgtcggcgtcggcgaccgaggtggtcagcggctcgccgagcgggtcggtctgcatcatctgcaggcggacgcggcgtacgggcaggtcgggggcgagttcgcggacgagtccggacagccaggccccggtggccaggaccaccgtgtcggcgcggtggacgtcaccgtggtcgtcgcggacggcgccgggaccggtcacctcgcggacctcccggccggggaggaaggtgtagcggccgtccgcccgggcccgcagggcctcgcgcaggtggagctgcgcggtgcgcggctcgacggccgcgtcccgctcgcaccacagggcggcctcgaacgcgccgcgcagggccgggttgatctcccgcgcctcggccgcggtgagcagcttgtagccgcgggcggcggcgtccgggcgggccagggccgcctcggcgaccgcgagttcgcgtggggtgcggacgggggtgagggagccgttggcgcgaaagcccaggccgggcacctcggcgccgatgcgctcccagagctcgcgggcccgcagggcggtgtcgagctcctctcccccggctcgtccgctgacccagatctggccgaagttgcgcagggacgcgccgcgggcctccgcttctcgctcgatctggacgacctcgtggccgcgttcgactgcttgccaggcgtgcatggtgccgaccacgccgcctccgacgactatgactctcacgccgccaacggtgggtcgggtccgtgacccgggaaggtcggtccggcgactcgccggtgaacaaccctcgacacttggactagacccgttatctttttgtgacttcactttgccccatttcgtttattacgagtgctttgctgtgtggctactcggcccgcaggcgggtcgtgaagctgaaccggtcaccacggtagagcgaacgcacgcgctccagcggccggccgtcctggtcgcgcgagaaacggtggatgagcagcatggggagcgcgggcggcgtgccgatcaacagggcttcgcgcggggtcgccaggaccgtctccagcttctcgtcggcctcgccgaaggagatgccgaggctgtcgcggaggtatccgtagaaggaggagtccggcgggaagtcgccgtccaggcggggggcccgggccacgcggatgtacgtactctccaggccgacgcgctcgtcgtcggccagcaggacccgctccaggtgccagacgggctcgccgggctcggcgccgataccgggcgcaaggtcgggcgggcaggggaactgctccaggccgatgagatgacggcccgggcgacggccctggcggcgcacgccttcggtgtagctggcgagggagagcggctgctccagcttggggccggcgacgacggtcccgcggccggagcggcgcagccggccctccaggagcagctcgcgcagagcctggcggacggtctcgcgggacacctcgtaccgctcggcgagatcgcgctcggtgggcagcgtgccaccctcgccgagctcgtcgaggagctcggcgatccgggccttgacggcgtagtacttggggatgcggccgtgttcgggaatgccggaacgcacgggtgagccggggcggtgccgctgggtctgttcttccacggtgggactctatgcggggcggcagccggtcaccgcgcgggcggtccgcgggcgccgggacggacggtgagcggaggcggggcggtcagtcggcggacgccggggcgggcgtctgcgggctccgcgacgggcggttcagcgtgcggaacggcgcagccgacgggcacccagcagcaggcctccaccggcggcgagcgcggccacggcgcctgtgccgtaggcccattcacgcggtcccgtatgggcgagggagcccgcctcgacgggatccgccggcccctcgaccgagaaccggtacccgcccgcctcgccgatccagtcgccgtcgtcccccttgcgctggacgagggcggcatcggcgacgacctcgccgacgggcgcgtccggagcgaaggagaggcccaccttgacggtcagggaaccgccggggccgacggtgaacccggggaaggcgtcgccgccgtcgaagacggcgatgatctcgtcgcggtcgctgtgctccaggctgaccgggaaggtgccgcccggggcgtcgaactccatgcgcaggtgcgcggggcgcagggtgtgggccttgtccgtgaagacgacgatcgggtggatggccgtgcactcggagttggtggtgttggtcaggtccaggtaccaggtctgcagcccggcaccggtgcggtacacggccggaccgccacggatccgcgccccgatcgggaaggcggtgctcttcccgtcgccgcaggtggcctgcgcgcgcgagggcagtgccggtgcgggacgtccgccgcccgcgccgatgtcggctccggcggtgggtgcggtggcggcgaccagggcgccggagaggacggcggtgagggcaagggctttgcgtagtcgcatggaagaccttcgctgctcgccggacgggacgatgatcggacgaggtgacaatcaccccggccctgcccgcaccctgccacccccgcgcgacccctcaccgggagccacgcctgagttgttctggtttacgcccggatggtggatgaggtcaaatcccccgcccccaccccgccggcgatcgaggcgcgggcccgggcagagcccgggcaacggcacggcagggcacggcagggcacggcagggcagggcacggcacggcacccctcacccctcgcgcccgaacaacggcgccagcgccagctccgccgccccctccgccacacccgcccctgccagggcgaccaccggccgggccggatccagcgcgcgggccgcgagaacggcgccgaccccggccacgaagacctccggcgccgccgtcaccacacgcccgcccagcagcacccggtccacatccagcagcgcgaccaggttggccgcaccctcgcccaggatccgtgccgcctcggacagatcgcctcgggccaccgcccccaggcacagcacctccacgcagccgcgcgccccgcaccggcacggcggcccgtccagcagcagcacctggtggccgaactcccccgccgccgagcgggcaccccggtagaccccgttgcccagccacaaccccgcgcccagcccggtcccgacgtgcaggtagacgcaggtgcgcggcccgccgccgatgtacgcgtccacgtccggcccgacagccacgccccgcacggcatccgcacccacggccgcacccgcataggcacccgcagccgcgcccgcaccggcatccacgcccgcaccggcctccgcatccgcctccggccacgcggcccggagccacgccccggcagccgcggccgcaccggcgttcgtgtccttgtccagcaccaccggcaggcccagccgtccctccagcaccccccgcagcgggaagcccttccagctcgggaaccccgtcacccgccccatcgccccggcccggtggtcgagcggccccggtgccgccaccccgacgcccagcagcggcagcccggccgggtccgcgacccgcgcgaccgcccgtaccaccgcctccaccgccgcctccggaccggccccgaagtccagcgggcccccgctctcggcgacgacgcggcccgccaggtccacccgtaccgcaaggatctcgtcgcggtccagatgtaccccgacggcgtggcgcacgtccggcaccagccggagcagggtgcgcggcttgccgccggtggacgccgcgcggccggcctccgcgaccagcccgtccgcgccgagccgggccgtgatcttgctgacggcctgcggggtgagccccgtacgggccgcgagttcggtgcggcccaggcccgccggtccggcgccgcgcagcaggtccagcagcagcgcctcgttgtacccgcgcagcgcaggcaggttcaccccgccgcgactctccccgctacccctgttcactcgcccattgtccaccctccttgcactttgacaacactgtcgccaaagtggttcccatgagcacctccgcccccaccacccccctccgcgtcggcctcatcggctacggactcgccggttccgttttccacgcccccctcgtgtccgccacggacgggctcaccctcgacaccgtcgtcacctccgacccggcccggcaggcccaggcccgcgcggagttccccgacgtgcacatcgccgccaccgccgacgagctgtgggaccgggacctcgacctggtcgtgatcgcctcccccaaccggacgcacgtgccgctcgccaccaccgccctcgaagccgggatcccggtggtcgtggacaagccgctcgccgccaccgccgccgaggcccgcgcgctggccgccctcgcggaccgcagcggaaccttcctctccgtcttccagaaccgccgctgggacaacgacttcctcaccctgcgccggctcatcgccgacggcgagctcggcgaggtccagcgcttcgaatcccgtttcgagcgctggcgcccgcagctgaagggcggctggcgcgagtcgggcgccccggaggagatcggcggtctgctgtacgacctcggcagtcacgtcgtggaccaggcgctggtgctgttcggcccggccgtacgcgtctacgcggagaccgacgtgcgccgcccgggcgccgagaccgacgacgacaccttcatcgccctcacccacgcgaacggggtccgctcccacctctacgtcagcgcgaccaccgcccagctcggacctcggctgcgcgtcctgggctcccgggccggctacgtgaagtacggcctcgacccgcaggagggcgccctgcgcgacggactgcggccgggcggggacctgccctggggcgaggagcccccgcacctgtgggggcggctgggctccggcgagtccccgctgaccggcggcgggatcccggtccccaccgagcagggcgactacccggcgtactacgcggcggtggcggccgcgctgcgcacgggcgggcccgcgcccgtgacggcgcaggaggccgcgcagtgcctcgacgtactggaggcggcccgccggtcgtccgaggagggcgtggtcgtggagctccccggccgttcagagcgctgaacgtcggcgcgtaccggagccgcgcacgcacgtgagaggcggggccgccgatggcggccccgcccctgcgtacacgcgcgccgcgtgcgcggcgtacacgttcgagtcgaggcggctacgcgcccttgaactcctggcgctgacggccgagaccctcgatctccacctcgacgacgtcaccggcccgcaggtagggcttcggctccggctgccccatggcgacgccaccgggcgtaccggtgacgatgacatcgcccgggtacagggtcatgaagtggctcaggtaccggacgacctcgccgaccgggaagatctggtccgaggtgttgccgtcctgcttgagctcaccgttgacccacagcttcacgtccaggacctgcgggttcgggacctcgtcggcggtgagcagccaggggccgaccggggtgaaggtctcgcagttcttccccttgtcccaggtgccgccgcgctcgatctggaactcgcgctccgagacgtcgttgaccagcacgtatccgccgacgtgtgcgagcccctgcacggccgagtccaggtagcgggcggtgctgccgatgacgacgccgagctcggcttcccagtcggtcttcacgctgccgcgcgggatcagcacggtgtcgtccgggccgaccacggtgtccggggccttcaggaacaggatcggctcggccggcggctccgcgccgatctcggcggcgtggccgaagtagttcaggccgatgcccacgaccttgccgatgcggccgaccggggcgccgatgcgcaggccttcggggctcaggaccggaagctcaccggacgcggccgcgtcccgtacccgggtcagcacggagtcgtcggcgagcaggccaccgtccacatccgtgatcaggccggacaggtcgcgcagggtcccgtcccggtcgagcagcgcggggcgctccgaccctacgggtccgacacgcagcagcttcatgggcattctcccgtggtcgtgggtggtcggccccggggcgtgcccagggccggccgatgggttgcggccatcggaggatttggtcgatcctccaagatgtccacccaatccgcaagaccctgttcacaggctggaacgcacgcctccacccgccgcctgctccgccggttcagactgctccgcccgctccttgcggtgctggagccaggcccgctccgccaccgaccacgcggtggtggtcagcaggtagagcccggcggccagcggcaccacggcggcagtgatcagcgtcccgaacgacagcaggggcagtacgccgcccagcttgcgcatgacctcctgctgctcggcactcacctcgcccatgaccccggccccggccttggggacggccttggccccgccgccggtcccgggcttcttggcggcagcggccttcttgggcgcagtggctgcggcggcggcagcggccgcggcgaccgaggcggccgtccggcgcccccgcaccgcgctccacgcggcgaccaccgcgatcgccccgaacagcccgaggaacaccagcccctgcgccccgaacgggccgccctcacccagcgcctcggtccaccgggcccccagcggcgcggcgaagagccgatggctcagcagctctccccccgacgagaacgtcttgtacatgaggaagaacaccggcagctggagcagcatgggcagacagccggccaccggggtcgcaccgcggaaggcggcccggctcagcgggtgcagcgcgagccgtacgagcacggtgaacagcacgatcgcggcagcggtcgcggattgcgccagtaccggctccagcagccggcccagctcagcaacaaggtgggtgaaaacggacacgcgggccctccgaagggtctcgtcgaacgtcgaaagaggtgcatttcggcgtgacgacccgcgaggggcgacgacagtgaatcagtcagcagaaggcgggaacgagaagtactgcgcgcccctacgcggccgtcgggacgagacggccgggcgccctgggccgcgaccggcccgaggcatcgggatcacgctgcggcaggaaagccgtgcgctgctcgcgatcacggatcgcggtgcgtattcggtgcggcggcacgggccgtacgagccgcgcggcagcggcgagggccgcggtgcccacggcgacggtggccgcgagggcgaccaccacggcgcccagcccgccctccccggcgaacagcccgaggattccgccgagcagcacgaccgggagcagcagggcaaggacccgcgaggtccccgcgtacagggcgagggacagcaggccgccttcgcgtcgttgccgagccatacggacctccccctcatccactcccgcgcacgaactcccgtacgacatcgatggtaaccgggcccaccggcagatccatcggccgtaagtatcgaggtcaggaagacttgagtagggtcccccagaccaccagccggtacttcgaggtgtactccggcgtgcaggtggtgagcgtgatgtacgccccgggctcgctgtacccctggtccggcttcaccacgctgcgcggcacgggcgcgatcaccccggtgtcccgctcggtggtctcgccgaggatcttcccgaccacgtacgtgtaccggtgcccgcgcacgtcgacgatcagctcgtcgcccgcccgcagccggttgatgtaccggaacggctcgccgtgcgtgttccggtgcccggccagcgcgaagttcccctgcgccccgggcccggcggtccccgggtactgcccggcgtaccccttgtcgaggacggcccgcttgtcgacgccctgcgcgacgggtacgacgagcccgaggcgcggcacccgcagcacggcgtacgcccggtcccgctcggaaggcccggcggcgggccgggcggcccgggtcgccgcggccgccgcccctgcaccccccgccccaccgggccccggcaccggaacgtccccggcgccgggctcggaagcagagggagagggagagggggagtcggaggcagaggcggggagggacacctcaccccaggcccgctccagagcctggacctgctcctgcgcggcggccgcggcctgccggttcgtccaccacacctggtgcaccaccagcaacaggaccaccacccccacggtgacgatcagctcggcggcggcccacaacacacccgcgagaccggcccggcgcacccgccggccgctcccctgcaccaccacgggtacgcgatctcgcacgggcggcaccctaagtcctcccccgtcaactgaccagcggcagtacggtgtgaaccatgcgccccgacacgcctgccgagcacatcgccgaagccgagcgcctcatccgcacggcgacccgctaccccgaggaccaggagcccttgctcctccaggccgcggcccacctcgaactggccgacgcacgcgaccgggcgagtgccctctacgaccaactcctctcctcctccccgtccgacccccacctgatcaaggccctccaggcggcgaacctctgggagtacggccacgaggcggaggcccgcgccctcatctcgggcatccgtgccgcctcgcccaaggaacccgcgccgtgggaggtcatcgcggaagccctggaggcccacgacgagctggaggcctcgcacgactgcttcaccgaggcggccaccctcctcatcgcggaggacgacccgctgaccccggccaccaccgccctcctcacgggccgccaccgcgtacgccgcctcctcggacgcccgcacgacgactgggacatggtcgccgacacccgccacatcggcccgatccccctcgacgagctccacgacccgaagcgcatctgggcgctgggctccgacgaccccgccgaactgcgcgccgagatcgcccgcctgcgcgccgaactgggcgaccgccgcgcggccctctcccgccccttcccggtggcgatcctgcactggccgcagcgcgaactgtcggagctgctgaccagctacccgaccctcgcctccgagtacccctcgcacgaggcccacttgagggacatcgaaacctccctccgcgccctggccgcctcgggcacgacgaacctgggcatcgtcacggcgagcgtcccctcgtacgaggccttcgccgcgtcggagaagacctccccggcctccccgtccctcctggccgaatacgccacgaccctggcagcgcgcggcaaggccgtcccctggcccccgacccccacggccccctgctggtgcacctcgggcaagccgtactcggaatgccacgcggccggcaactagccggaatcggccatggcgtgacgggcagtgcgcctcctcaggcgcaaccagcggcggcccgcacgcgtggatgctcctgggtccggcagattacgtccgccacgagggaagcaaccccatggggatccagtggcggctgcaccacgagatccccgcggacgtctggtcctattccgccatcgccggctagtcgctggctccgggcaacgggacgggcccggcaatagaagtgggctagcggtccgccgccgcgtaggccgccgtggctaccgcggccgccgccgtgaagaccgccggccaggggccgatcttcttcgccagggggtgtgatcccgcgaacgcggcgacgtaggccgcgccgaggagggccgtggtcgtcggggtcgtgcggcggtgccattcgcgggccgcgacgctgcccgcggccgccaggaccacgccgcccagcgggcgtacgccggtccagcgggccgtggcgtagccgccgaccaggccggccgccgctatcgccgaggtggggatctgcgccatcgaggggcctccagtcgttcgaacgtgacgtcgctacgaggctaacgcgcgcgccgcgtgaagcggcgcgcggtcgtcacgcccaggaccacgacgcccccgccgaggacgccgggcgggacggtgtcctggacggcgcggggcagtaccgcgatgacgcccagggtgaggaagaacgccaccgcgcacgcggcgaggccgaccagggctttgtggaggagagaggtgggcacaccgggttcaacgccgcgccgggggcggcgatacgggcggaccggaaccccgtacggaagtcggatttgtcgcacaccctccggatctgcggacctcccttccggggaacgtacccggcgtagattcgctcttcgataggggcgatacgacccaagccgcccaagccggcccaaggagctgcaaacgtgatctgttatggaccggccgtgctggacctgtcggacgaactggccgacgcctacagcgaggtgttctccgccccaccgtggaacgaggacgaagaaaccattcgccagttcgccctccggctccaggccgacagccgccgcgccggtttccgtaccgccttcgcgcagtcggccgccggcatcgacggcttcgccaccgcctggatcacccccaaggcgttcccccgcgaccgcggctacggacaggtctccgcgcagctcggccggccgcgcgtacgggaactcctcatcggcgccctggagatcgacgagctcgccgtacgcccgcacgcgcgcgggaccggcaccgggcgcgccctgctcgccgagatcaccgccgacgcccccgacgaccgcgcctggctgctgaccgcacgggtggccaccgacaccgtcgccacctaccggcgcctcggctggcacgaggtcgcccccctgcccggcacgcagaacggcgtcgtcgtcttcctcgccccgaaccacccctcggcctgagcatcgcccgcaccccaccgggcataccccgggcatgatcacccgtatcgcgcagcggcagcagaacctggccacctaccaccagctcaggcaggccgggatcccggccgccaccatcagcggccgcagccgccgcggaggaccctggcagcggctcctgccccgggtgtacctcctgcagaccggcccgccggacacccggcagcaggcgctgtccgccctcctgtacgccgcccaccccacggccgacccgctgtccggatccaccgccgcgctcaccggcggcagcgcgctcgcgctcctcggcatccgcgacgccccgcccgaaccgctcgacgtcctcgtccgcgccccgcgctcgcccgtcgccacgggccgggtccggccctgcccgacctcgcgctggcccgccaccatccacgtctccggcgtccccagcacccgcccgatccgggccgccgccgacttcgcggcccgtacggacgaccccgacctggtgcgctccgtactggccaacgtcgtccagggcggctggtgccacccgcacgacctgcacgccgaactgcgcgcggcccgggtccgcggccgccccgccgtacgggtcgcggccgccgagctggtcgccggggtccgctcgatcgccgagggccgcgcccgcgacaccctggcggcgaccgacctcccggccccgctctggaacgcccgcctccacggcccggacggggccttcctcgccagcccggacgcgtactggcccgacgagggcgtggccctggagatcgactccgcggagtaccactacacgcgcgacgcctggcaggccaccgtccaccggcggctgcgcctggaatcccggggcgtcctggtggccagtacgacacccggaatcctgcgcgacagaccggccgacgtgatcgccgccttacgcgcgctcctggtactgggcgccgcccgccccgcacccgcggaggtcaccgcccgcggccacgcccagctggagctgccgctcccgccgccctacgccccgaaggcgcgggacaccgtatagatcaacaggcccgccagggcgccgaccaccgtgccgttgatacggatgaactgcaggtcacggccgatgtgggcctcgatcttgcgggaggtgtgctcggcgtcccaggccgccaccgtgtccgtgatcagcgaggtgatctcggtccggtaggtggtgaccacgtagacgaccgcgccctcgatccagccctccaccttcgcctgcaggcggccgtcggtggccaggcgcgcaccgagggagatcagcgaggcgcggaccctcaggcgcagctcgctctgctcgtcctccgccgccgagatgatcatcgaccggatcgccgaccatgcggaggcgatgacgtcctggacctcgtcgcgtgccaggatctcggacttgagccgctccaccttcgcgcgggtctccgtgtccgactggagatcggccgcgaagtccgtcaggaaacggtccaccgccccgcgcgccggatgctcgggcatgtcccgcatctccgtgacgaagcggagcagctccttgtagacgcgctcgcccaccttgcggtccacgaacctcggggtccagccgggggcgccgccctggaccgcgtccgtgatcgaggccccgtgcgtgaccagccagtcatgggccttggcgcagatgaggtcgacggcccggcggtggccgccgtcctcgacgacccgctccagggtcttgccgatgcccggagcgatctcggcggtctcggcgcgccgggtgatggcctcgccgacgacggcctggacgtcggagtcgcgcagcacggtgagcgcgccgcgcagggcggcggccagctcggcggtgacccggtccgcgtgttcgggctcggccagccaggagccgaggcggccgccgatgccgagggcgtggaggcgggcccggaccacgtcggacgagaggaagttctcgccgacgaactcgccgagggtgacgccgagctggtccttcttggtcgggatgatcgcggtgtgcgggatgggcaggccgagcgggtgccggaagagggcggtcacggcgaaccagtccgcgagcgcgccgaccatgccggcctcggccgcggcggcgacgaacgcggcccagccgccggcgccccaggcgtgctgggcgtacttggcgagtacgtagatcagcgccaccaggagcagcaggccggtggcggtggccttcatccgccggaccccgcggcggcgctcctcgtcggcggcgctgaacacgaacatgccggctgctgcgcgggcgggcggggcgttgccgttgcctccggcggttttgcggttctccacgtgatcctgccttcccccgggcgccgggtttgtctgcatagcatccgactcctgggaggccgggggagttcccgccacgcccttccgctcccgcggcgggtagcggtccgggccgcgccgctgcccccggcggggcgtggtgggggccgcgccggtgcccccgggcggggcggggtcctgggcgtggtgcgggttggtccgcggggccgggcaggggtgtctcctcggctcgcgcctgcggcggggccggcccgtacggggtggttgcgcgctcgtcctgcggggacacccctgcccgtccccgctccccctgcgtcgggcccggcttcggggcactgtcgaagcacttccgtggggtggggacacggcggagtgtccccgcaggacgagcgcgcaacccaggccgacacagcaccacacggccgcaggcgcgagccgaggagacactccggcggggcaccaccccacaccaccagccccggacggagccggggctacagctctttgcggagggacgggccgccccgcgggggtttgcgttgtttgaccttgacctccacgccgccccagaaggcgaagcccgtcaccaccaccctcggcgcgcccggttccgaccggcccgggctgtcgcgctggtcgaacgcgcccatgaaaccgaagccccgtacgtcgagctccacccccggcggcaccgtgatctcgatgccgcccatgacggcgacgcagttgatcaccacctcgcgctgcgcgaagtccgcctcccgcaggtccagctccccgccgccccagaacgccaccgcgtcgaaccgcgccggcaccgtccaccggcccttgcgctggaagcccgacatcaccgcgacggccgtccccgagccgcccgccccgccgatccggcccgtccagggctccgcggccgccgtcggccgggccaccggcccgccgtccgccggcgccggcaggtcccgcgtcagcggttccagttccgcgtaggtccgcgacttgtacgccgcgtccagccgctcctcgaactcttccatgtcgagccggccctcggcgacggcgtcccgcagacgctccaccacccggtcccggtcggcgtccgacgccctcagctccggcaacggcttctccggccgctcgtcactcatgcggaccagactatgcacggtggtcggggagttgtatggctcggctcctgagatcgcctccggatcgcccccggcttttccctgatccgggcgcacccgcgaagcgtcagccccgccccgcgtacatccgcgcgatcacgtcctcgatgtccggctcccgcaccgacaggtccaccagcggatagtccgccgccaccgccgccaccagcggtgccgccgacgcccccgccgggaacgccagccactgccgcggtccctccaccttcaccacccgcgcccccgccacactgatcggcccgagctcccgctccaggtccaccaccagcgtccgctcgctctcgccggccgctcccgccgtgtgcagcccgcccagcggcccgtcgtacatcagccgcccgtggtcgatcaccatcaccctctcgcacagctgctcgatgtcctggaggtcgtgcgtcgtgaggagcacggtcgtaccgagttccgcgttcagctgccgcaggaagccccgtaccttcgccttgctcaccacgtccagcccgatcgtcggctcgtcgaggtacaacacctccggatcgtgcagcagcgccgccgcgatgtccccgcgcatccgctgcccgagcgacaactggcgtaccggtacgtccagcagctcggccaggtcgaggcggtccacgcagcgctccaggttctcctcgaaccgcgcccgcggcacccggtacagccgccgcatcagcccgtacgagtccttcagcggcaggtcccaccacagcgtggtgcgctgcccgaacaccaccccgatccggtgcgcgagccgcatccgctcccgcgccgggtcgatccccgcgacccgcagccggccgccggtcggcgtcaggatgccggtcagcatcttgatcgtggtggacttcccggcaccgttgggcccgatgtagccgaccatctcgccgcgggcgacctcgaagctgatcccgtccaccgccctgacctggtgtttctcccggcgcatcaggctcacgcggcgccgtacgtcaaagaccttctcgaccccgtccaacgagatcagcgcatccgccacagctctagctccccgtgcttcggtacgaacggactcccgcgcgccacgccagcgacgcgggcaggaacaccacgaaggccaccagcgggctcaggtacgcgacccacccgggcagccccagcggatcgggccgccccagcacgtgcagggcgggcagccagttgacgaaggccagcgggacgatgaaggtcaccccgcgcagcaggtccttcgcgaagaccgtcggcgggtactggagcatcgtgcagccgccgtaggtgaaggagttctgcacctccgccgcgtccccggtcacgaactggaaggccgcgccggtgaccatcaccgccccgaagatcgccgccccggcgatcaccatcacggggaccagcagcaccttcccggccgtccagtccacgtccagggtccagagcgcccagcccatcaccccgagcccctgcccgatccggcccagccggcgcagcgcgaaccggtccgccgcgacctgcgcgagcaccgggacgggccgtaccagcatcgtgtcgagcgagccgtcgcggatccgggcgccgacccggtcggtgttccccagcagcaggtccgccaggcccagggaggccgagcaggatccgtacagcagggcgatctcgggcagcgtgaagccgccgagcacgtcgacgtgcgagaacatgatgaagatcgcgacgaagtccagcagggtgatcgccgcctgcccgacggtcgtcagggcgaaggacgtccggtaggtcatcgtggaccggatccacatcgccacgatcagccggtagccgcgcagcccctcccggaccggaccgccgcgccgcggccggccccgctccggcgcgggcccggcatccaccgcgaacccgccggcccgcgcacccggcgacagggccgccgcttccgcctcagccaccctggaccaccaccttccgcgtcgcggccgactgcaacagccgccccgtgcccagcagtacgagcgcccacccggcctggaagcccagcgcctcggccgcgcctccggcccccgcgtgcttgcccagcaggacgtccatcggaacctgcagcatcgccgcccacggcaggacgcggacgaactcgccgaagccgcccgggaagacggtcagcggcagcagcatcccggagaagaagaccgaggcgagggtggccatgatgttgacccccgccccgtccatcagccagaaggccaccagccccaccatgtagcgcagcgcgaagctgaccaccagcgcgagcaggacggacaccaggaacagcagccagcgcagcggatccgagggcagcgccagcgggaacgccagcgcgcccgccaccagcggcaccacgccgcggcccagcaactggaaggccgcccggcccagatcggccgcgagccaccacagctggaggtccgcgggccggtagaggtcgacggcgatgtcgcccgtccggatccgctcctggagctcctcctggaagccgccgccgatcagcgcggcggcggccagcagcgattggctcacccagacgaaggtcagcgcctgcgcctggtcgtagccgccgagtccggggcgctcgtcccacagcgcgatgtacgtgtacgcgacgatgaacccgaacacggtgttggtgaacaccccggccgccgtcgccgtcccgtaggtggcgtagcgcctgaatccgccggccgcgacggccaggtggagacgcactgtccgaagcaccgtatccctccgtttcccacgtcgttcctacgtcggccaaagcgcgcgagcttagtgcggaggggcgagccacgcgaccgatttatgcccgtccggagcggaatcagcggccatcgggtagacaccatgaggtacagaagtggatattttgaacggcgtcgaggagtcctggagatgagcgaccagtcaccacccccgggctggacccctcgcgaccccgacaccccgcccgacgtaccgcagccgcgggcggcgacacccgacgaggcatcgcaccagggccggccggggaagggggccgggaagaaggcccggcgcaggaggaccggctggcgccgcgccgtccccacctggcgcatggtcctgggcaccgtcctgctcctcgccctgctgatcggcggggccctcgtggccggctacctgctggtcgacatcccgccggccaactccgccgccaccgcgcagtccaacgtctacctctactccgacggctcccagatcgcccgcgacggcgaggtcaaccgcgtcaacgtgccgctgtcgcagatcccgcggaccgtgcaggaggccgtactggccgccgaggaccgggacttctactccgaacgggcggtggaccccaaggcgatgctccgggccgcctggaacaccgcgaccggcaagggcacccagtccggttcgaccatcacccagcagtacgtcaagaactactacttgggccaggaacagacgatcaaacggaagatcaaagagttcttcatcgcgatcaaactcggtcgtgagaagtcgaagaactacatccttgagggctacctgaacaccagctacttcggccgcaacgcctacggcatccaggccgccgcccaggcctactacggcaaagacgtcaacaaactcaccaccgccgagggcgcctacctcgccaccctcctcaactcccccagcgccttcgacgtcgtctcccacccccagagccgcccccgcgccctcgcccgctggaactacgtgctcgacggcatggtcaagaagcaatggcttcccgcagccgaacgcgccaccacccagttccccgaaccgggcaaggtccgcgcggccgccggcctgtccggccagcgcggctacctcgtcgaagcgatcaaggactacatcgtcgacaacaagatcctcgacgacaagaccctcgccgaaggcggctaccgcatcaccaccaccatcgacagacgccgccagggcgccctcgtcgaagcggtcgacgaccagatggtcagcaagctcgaacccgagacgcgcaaggcggaccggctggtccgggccggcggggtctccatcgacccggccaccggcaaggtcctcgccatgtacggcggcatcgactacaccaagcagtacgtcaacaacgcgacccgccacgactaccaggtcgcctccaccttcaagcccttcgtcttcgccgccgccgtcgagaacgactcccgcacccaggacggccgccggatcaccccgaacacgatctacaacggcgacaaccggcgcccggtcgtcggcggccgcatccgcttcgcccccgagaacgagggacaggtctcctacggcaacatcaccgtcaacaccgccaccgacctctccgtcaatgccgtgtacgcgcagatggcggtcgacgtcggcaccggcaaggtcaagaagaccgccatcgacctcggcatccccgagaacacccccaacttcgtccccggcccggccatggccctcggcaccctgcaggccagcgtcctggacatgacccaggcctacgccaccctcgccgaccacggccgccgcaccccctacaccttcctggagaagatcaccaagggcggcgacaccatcggcctcccccagcgcacccccacccaggccatcagccgcgaagccgccgacaccaccacgtccatgctcgtcagcgtcgtggacaacggcaccggtacggccgccctcgccgccggccacccggccgcgggcaagaccggcaccggcgaactggaccgctcggcctggttcgcggcctacaccccggacctcgtcaccgtgatctcgatgatgggccaggaccccgacaccggaaccctgcaatccctctacggcgccctcggcgaggcccgcatcggcggcggcggctaccccgcccggatctgggccgcgtacacgaagaccgccctggagggcaccgaccccgtcgacttcgacctggaactccagcccggcgccgcacagcccccaccaccgaccggccaggaatcgaacccgccgcaggaaaccaccggcgaaccctcgcccagcacctccgagcgcccgacccggccctcgccgtcgaacccgacgggcggccgcaaccagggcggacagaacaacggcggccagaaccaaggcggccaggacaacgggggccagaacaacggcggccaggacaacggcggtcaaggcaacggcggccaggacaacggcggcaccacccagggcggcgaccagggcggcaccacccagggcacccagggcgccacccagggcagcgcgcaaggcaccgcccagggcagcgcacagggcagcgacggcggcccggccgaaggcctgcgaccgccgtcggcgttcctcgaatagcgcggatcagtgaccggaggtcgccttcagccccaccacggcgaccagcagcagacagatgaagaagatccgggcggcggtgacgggctcacccagcaccgccataccgagcaccgccgcgccggccgcgccgatgcccacccacaccccgtacgccgtaccgatgggcagggtcttcgcggcgtacgacagcagcaccatgctcgcgacgatcccggcacccgtgaacacactgggccacagccgggtgaaaccgtccgtgaacttcatgccgatcgaccagccgacttcgagcagaccggcgacgagaagaagaacccatgccatgacggcacctccgagacaacgagcgatacggggtgcgtcgtcttgtcgtacccggtacggcgcgtctcgtcggggttctcccccaccgtagcaaaagacggcaaaaagggccggtgacctgcgccaccagccctttcctctcccgcggccccctacaggtacagcccggtggagtcctccgacccctccagccgctccgcggccaccgcgtgcaggtcccgctcgcgcatcagcacgtacgtcgccccccgcacctcgacctcggcacggtcctcggggtcgtacagcacccggtcaccgggctcgaccgtccggacgttctgcccgaccgcgaccacctccgcccaggccagccgcttgcccaccgcggccgtcgcgggaatcaggatgccgccgccagagcgccgctcgccctccggcagatcggacttcacgagcacgcggtcgtgcagcatgcgaatgggcagcttgtcgtgggtggtgttgtcgctcacgccccgaacctacctgcccgctgccgccccgtgacgctcagggtcatccgcgcttgcggcgcgccgacaccacgagcagcccgaccagactcaccgcgaccagcgcgacgggcacgatccggtcgatgcgcggagccccgtcgtcgtgacgcagcccgtccttcaggtccgtcacgatccggttcaccgtggcgaaggcccgcccggcggtctggtcgacggtcgaggcgacccgtgccttcgcgtccccgatgatcgtcttcgggtgcatgcgcacgccgatctcgtcgagcgtctcggcgagctgctcacggcggcggacgatgtccgcctcgatctgtgcgggggtcctggcttccggcaccgcgctgcctccgtcgtcgtggtcctgtggggcgtagtccgccatgaacagtctgtcagcttagtctcatggcataccgatcccctcccgaggagagtgtcacgatgagcgagcgactccagccgggcgacaccgcccccgccttcaccctgcccgatgcggacggcaacgaggtctcgctcgccgaccacaagggccgcaaggtgatcgtctacttctacccgtccgcgctgaccccgggctgcacgaagcaggcctgcgacttcacggacaacctgtccttcctgacgggacacggctacgacgtcatcggcgtgtccccggacaagccggagaagctggcgaagttccgcgagcaggaggacctgaaggtcaccctggtcagcgacccggagaaggagacgctgacggcgtacggcgcgtacggcgagaagaagctgtacggcaagacggtcaccggggtcatccgctccacggtggtcgtcgacgaggagggcaaggtcgagcacgccttctacaacgtcaaggcgacgggccacgttgcgaagatcatcaaggacctgggcctctgaccccccgccgccccacggaacggcccgcacccccggtgcgggccgttccgttcaccggacgtaaccccccgtaaccgtccgcgtcccggacccgttgttccgtacgagtgccgcacatgcggccgaacgcacgggggcgaaaatgaacgacgcgtacgagcgggaggcactggccgcggccgttgcagaatcgaagaactgggccgatctgatgaggcggctcgggctgagggccagtggcggacagcaccgggcgctccaggcgaaggtgacgctccacgggatcgacaccgaccacttctcacgccggggcttccggcacacctacacggacgaggccctcgcctcggccgcagcctcctcctcgaccgtccacgaggtagcactgaaactcggcgcccgaccggcgaccggcaccctgtcgcacatcgttcgccgcatgagcgcggcaggcatcgacaccagccacttcaagggcgcgaagcgtgatcgcgtcgagttgcccttcacaggggaggagctcagggacgccgccgcctcctccgacagcatcaggggtacggcgcgcacgctgggcatgatcgacgacggccggtcgcgtgccgcactcgcgagagcgctgaaaaagcagggcatcagcaccgctcacttccggaactcgcgcctgctcatccccgaggccgcattgcgtgcggccgttccgggcgctacgagttatgcggacctcatgcgtgcactcggcatcgaggtcaacgacgtgaaccaccgccgactgcgacgcaaggtggcacaactcggactggacgtccgtcatttcacgcgccgcccgtggagccggcgtccggcggcgacggtcgagcccatcgcaccttccgtactcaccctgcgtccggaagggtccccgcgacccaaacgctcccgactgcatcaggccctgcaggaagtcggggtcccctacgcctgcgccgactgcgggaaccccggcgaatggcgggggcggccgatcacccttcagatcgatcacgtcaacggcgactggctcgacagccgacgcgaggacctcaggtacctctgccccaactgccacaccctgacggacacgtggtgccggaagcgccctccccgggctgactccagccccggtcgcccgtagactgagagcgacccagtagggcgcaatgtctgaattgggtcatatgtcgcggttgtggtggaattggcagtcacgcttggtttaggtccaagtggggtaaaacccgtgggggttcgagtccccccaaccgcacactcacgtcgaaggccccgtacgcagttgtcgcgtacggggccttcgacgttgccgcgtcccggcgacggcccgccggatcgagcggcgtcagcccaggagggctcggacgaaggggaccagggcgcggaaggcctggcctcggtgggagatggcgttcttctccgccgccgtcagctccgcgcacgtgcgggtgtcgccctgcggctggaggatcgggtcgtagccgaagccgcccgtgccggacggggtgtggcgcagggtgcccaggaggcggccctcgacgacgcgttcggtgccgtccggcagggccagggccgccgcgcacgcgaagtgggccccgcggttctcgtcggcgatgtcgccgagctgggccagcagcaggtccaggttggccttgtcgtcgccgtgcgtcccggcccagcgggccgagaagatgccgggggcgccgtgcaggacgtccacgcagaggccggagtcgtcggcgaccgccggcaggccggtggcgcgggccagggcgtgggccttgaggagggcgttctcggcgaaggtgacgccggtctccttgacgtccgggatctccgggtacgcgtccgcgccgaccagctcgtgcggcaggccggcgtcggacaggatcgcgcggagttcggagactttgcccgcgttgcgggtggccaggatgaggcggctgggcgtcgaggtcatgccctcattatcccggggtgcagaccttggagagctcgcttgccgcgtccgcgaccggctggatgtccggggcggtgttgccgctctcgatcgaggtgcggacgttcttgacggcggtgttcatcgagtcgatggccttgcccaggtcggcgttgtccgtctggtcgccgatcttcttgaggttcgactcgatctggttgagcgcgttctgggcgtcctgggggctgttgcccgcctgggagacggcctgctggaggtcgttggcgccgtccgtgatggccacggccgtgttggcgcagtccatcgcggtggagatcgcgtcgcaggacgtgagggccgggacggtcagtacggctgccacggccacggccgctatgcggagcttcatgcgcttctcccccagtgggacttcggttcgtcgacgggtgctggactgtactggacgggcgcacggctgtgaccccgtgcgcccgtaccggaacagacgcgaaagcgcgcgccgcggttgccgtctagagttcgagcgcgttgcgctggatggcttccaggtcggcgcagccgccggcggcgaggtcgaggagggcgttcagttccttgcggtcgaagggctcgccctcggcggtgccctggacctcgacgaagcggccgtcgccggtgcagaccacgttcatgtcggtctcggcgcgtacgtcttcctcgtagcagaggtcgaggagcgggacgccgtcgacgatgccgacgctgacggcggcgacggtgccggtgaggggcttgcggccggccttgacgaacttcttcttctggccccaggcgacggcgtcggcgagggcgacgtaggcgccggtgatggcggcggtgcgggtgccgccgtcggcctggaggacgtcgcagtccaggacgatggtgttctcgccgagggccttgtagtcgatgacggcgcgcagggagcggccgatcaggcgggagatctcgtgggtgcggccgccgatcttgccgcggacggattcgcggtcgccgcgggtgttggtggagcggggcagcatcgagtactcggaggtgacccagccttcgccgctgcccttgcgccagcgcgggacgccttcggtgaaggaggcggtgcagaagactttggtgtctccgaaggagacgaggacggagccctcggcgtgcttgctccatccgcgttcgatggtgaccgggcggagctgttcgggcgtacggccgtcgatgcgagacatggctccgagcctagtcgctgcccgcgcgggcccgtgccgctgcgccctgtgcccgtgcgcccgtgtgccgtgtgccgtgtgcccgtatgcgaagaccccgtccggggcttccgggacggggtccgctgggacctgttcagtgggtccgggtcacatcatgtcttcgatgtcggcggcgatcgggtcggcgtcggtgccgatgacgacctggatcgcggtgcccatcttgacgacgccgtgggcgccggcggccttgagtgcggcttcgtcgaccttgctggggtcgatgacctcggtgcgcaggcgggtgatgcagccctcgacctcttcgatgttctcgatgccgccgagcccggcgacgatcttctcagccttggtggccatgtgtgtctccctgagtgtttcgaagaacgagtctcggcggccggtacacggctaccacctgcacggtccgctttgtcacggtaacgcacggttggcccatctacgcgagcgcgtgaccgacccctgccgaatgatgacgatcagcagcaacctacccacaactggtctacaccagtgtgccgtacgtgttgccgcagccaaaaacgggccggtcagggaggacgtcgatgagcgcgagcagcgccaccgcagtgccgcaaccgaattggcggcacagcgcgttccaggggttgcagaagatgggccggagtctgcagctcccgatcgccgtactgcccgcggcaggcatcctgttgcggctgggtcagccggacgtcttcggcgcggacggcctgcagtggacggacgtcgccaaggtgatggcgggcgcgggcggggcgctgctcgaccccgatctcggcctccccctcctcttctgcatcggtgtcgccatcggcatggcgaagaaggccgacggttcgaccgctctcgcggccacggcgggcttcctcgtgtaccggggggtgctgcactcgttccagaaggcctgcccggtggggaccaaggacatcgggggcggctgcctggggccgaacgacaccttcgtggcctacacgtaccagaatccgggggtcttcggcggcatcgtcatgggcctgctggcggcctggttctggcagcggtaccaccgggtgaagctggtggactggctcggcttcttcaacggccggcggctggtcccgatcatcatgtcgttcgtcgcgatcgccttcgccgcgctctgcctgtgggtctggccgccggtcggggacgcgctggagagtttctcggactggctgcgcgggctgggcgcctggggtgcgggcatcttcggtgtcgcgaaccgcgcgctgctggtgatcggactgcaccagttcctgaacgtgccgatgtggttccagttcgggtcgtacacggcggcggacgggaagacgtaccacggcgacatcaacatgttcctgcacggcgatccgaacgcgggcctgttcctgtccggcttcttcccgatcatgatgttcgcgctgccggcggcggcgctggcgatcacgcactgcgcgaagccgcggcggcgcaaggaggtcggcggcctgatgctgtcggtggctctgacctcgttcgtcacggggatcaccgagccgctggagtactcgttcctcttcgtcgcccccgtgctgtacgtggtgcacgcggtgctgacgggcgtgtcgatggcggtgacgtggggcctgggcgtccacgacggcttcagtttctcggcgggcctgatcgactacctcatcaactggaacctggcgacgaaaccctggctgatcattccgatcgggctgtgcttcgcgctcgtctactacgtggtgttccgtttcgcgatcacgaagttcgacctcgcgactccggggcgggagtcggacgaggagatcgcggcgatggagtcggagaccaccaaggcctgagcccggccagccagccaggccaggccaggcccgcccggtccccgcagggttaccgtacggtccgtcaagggcctccggatcacgatccggaggcccttcggcatccctccgggagtgtgatccaggccacaggaaatcgaaggttccttatctaaccctcaccgtgttacaactggtctacaccacgattggtgtagaccacgcgggcctgtctgagcccgcgtacccccaaatccgagacgtcgccgtcccccgtttcccccctggcgtcgccttgcccactggaggaagttgtgaccacggctaccgccccctcggcggaaaagaagaagggcgccggcgtgatggccgtcatgcagcgcatcggccggagcctcatgctccccgttgccgtgctgcctgccgccgcgctcctggtgcgtctgggcgacaaggacatgctgggctcggcttcgatgccggagttcatcaacaagatcgccggctacatgtccgccggcggtggcgcgatcctcgacaacatggcgctgctgttcgccgtcggcatcgcgatcggcttcgccaagaagtcggacggctccaccgccctcgccgccgtcaccggttacctggtcttcaagagcgttctggccacgttcaccgactccaaccttcccaaggtggccaaggccgtcgacggcaaggtcgtcatgatcgacgcgcccgtggacgccaaggtgctcggcggtgtcgtcatgggcatcgtggtcgccctcctgtaccagaagttctaccggaccaagctgcccgagtgggcgggcttcttcggcggccgccgcctcgtcccgatcctctcggccttcgccggcctggtcatcggtatcgccttcggtctggtctggccggtgctcggcaccggtctgcacaacctgggtgagtggctggtcggctccggtgcggtcggcgcgggcatcttcggtgtcgccaaccgtgctctgatcccggtcggcatgcaccacctactcaactccttcccgtggttccaggccggcgagtaccagggcaagagcggcgacatctcccgcttcctcgaaggcgacccgaccgccggccagttcatgaccggcttcttcccgatcatgatgttcgccctcccggcggcctgcctcgcgatcgtccactgcgcccgccccgagcgccgcaaggtcgtcggcggcatgatgttctccctcgcgctcacctcgttcgtcaccggtgtgaccgagccgatcgagttcaccttcatgttcatcgctccggtcctgtacgcggtccacgcggtcctgaccggtgtgtccatggcgctgacctgggccctcggcatgaaggacggattcggcttctccgccggcgcgatcgactacctgctgaacctcggcaaggcgacgaacccgttcggcctggccctggtcggcctctgcttcgccgcggtctactacgtcgtcttccgcttcgcgatcaccaagttcaacctgcccacgccgggccgcgagtccgacgaggagctcgccgagctgctgaaggcggaggccaagtaggcccgctcgcccctgtgtcgaagcccccgctctcccggaagggagggcgggggcttcggcgtgtcgcggtacgtcggacgcggtaggtcggacgcggtgcgcggtgcgtcagatctcgtagaccgcgcccgcgtacgccaggtccaccgggccgccgtagaccgcgcgggcatcggccaggttctgctcggggtcggtccacggcgggatgtgggtgaggacgagccggcccacgccgccgccgtgcgcgtactcgccggcctcgtggccgttcaggtgcaggcccgggatgtcctccttgccgtgcgtgaaggaggactcgcacaggaagaggtcgctgccgtcggcgagcaggcccagctcggggcaggtgccggtgtcgccggagtaggtgagcgagcggccaccgtgctcgatgcggatgccgtacgcctcgaccgggtgggagacccgctcggtgcgcacctggaacgggccgatctcgaaggtcccggacttcagcgtgcggaagtcgaagacctcgctcatcgagcgctcgtcggggacgtcgtcgtaggcggtggtcaggcggcgctcggtgccctcgggcccgtagacggggatggtgccgcagcggccgccctcgtgccggtagtagcgggcgacgaagtacgcgcacatgtcgatgcagtggtcggcgtgcaggtggctcaggaagatcgcgtcgaggtcgtagaggccgatgtggcgctgcagctcgccgagggcgccgttgcccatgtcgaggagcagcgcgaagccgtcggcctcgacgaggtagctcgaacaggccgattccgcggacgggaacgaccccgaacagccgacgacggtgagcttcatggagcgtgaacctccgaggacggtccgtggacggaatgcgggccgtgcgtgcgtcgagcgtaaggcgcgaaaggtccggtcgctcctccgcggcaggccgttgtggggggaatcacctgcgctgtcacccgggggagcgacggtgggcacgggcgttgccatgccggggcgttcccgcacggctacggtcgaagcatggacacgtcctggtggcccgcggtggccgcggtggtggccgtggcactgctggtgctggtcgccgggggccgttccgggatgccccggcggacgccgcccgcgcacgggaccggtccgccgccgcagccgcgggcgggcgagttgtggtgcctggccgacggccgtacgtgcctggtcctcgcggtggggtcggtacggggccaccgggcgcgggtcgcgtggatcaccgggaagtacgacgaccggcgggccggggtgatcccgctgcccccggggacggtcggggcgcagggccgggcgagcttcctggaggcggaccggcccgcggaggtgtcgctgtgggagttccggacccggatggggatgctggaccctgcggtgtgggacgagatcaagggtctgggaggcgcgaggtgacgcgggagccggtgatccgcctgcggcgggtgtacgacccgccggagccggcggcggacggggtgcgggtcctcgtggaccggctctggccgcggggcctggcgaaggcggtggccggggtggacgagtggccgaaggcggtgacgccgtcgacggagctgcggaagtggttccacgacggggggtcggcggaggagttccgggagcggtacgaggcggagctggcggagccgggggcggtggcggagctggcgcggctccggtcgctggccggggcgggcccgctcaccctcctgaccgcggtcaaggacccggcgtccagccacgcggcgatcctcgcggagcgactcgccgactagcggtgcggtgcggtgccgctgcacggggctccgccccggaccccgcgcctcaaacgccggcggggctgatcttcagcctcgccggcgtttgaggcccgggggtccggcggctgcgcccccgcaggggctacgcccagagctggccctggaggacctcgatggcttcctcggtggtcgcggccgtgtagacgcccgtcgacaggtacttccagccgccgtcggccaccacgaagacgatgtccgccgattcgcccgcggccaccgccttgcggccgacgccgatcgccgcgtgcagggcggctcccgtggagacgcccgcgaagatgccctcctgctggaggagctcccgggtgcgggtcaccgcgtccgccgagcccaccgagaagcgcgtggtgagcacggacgcgtcgtagagctccgggacgaagccctcgtccaggttgcgcagcccgtagaccaggtcgtcgtagcgcggctcggccgcgacgatcttgatcccggccacgttctcgcgcaggtagcggccgacgcccatgagggtgccggtcgtgccgaggcccgccacgaagtgggtgatggaggggaggtccgcgaggatctccgggccggtggtggcgtagtgcgcgcccgcgttgtccgggttgccgtactggtagagcatgacccagtccgggtgctccgcggccagttccttggccacccggacggcggtgttcgagccgccggcggccggcgacgagatgatctcggctccccacatggccagcaggtcacgccgctcctggctggtgttctccggcatcacgcacacgatgcggtagcccttgagcttggccgccatcgccagtgagatgccggtgttgcccgaggtcggctccaggatggtgcagccggggtacagccggccgtccttctcggcctgctcgaccatgtggagcgcggggcggtccttgatcgatccggtcgggttgcggtcctccagcttggcccagatgcggacgtcgtccgagggcgacagccggggcagccggaccagcggcgtgttgccgaccgcggccagcggggagtcgtagcgcattacttcgatccgccggccacggccgggaggatggtgacgctgtcgccgtccttgagggcggtggagatgccgtcgaggaagcggacgtcctcgtcgttgaggtagacgttgacgaagcggcgcagctggccgccgtcgacgatgcgctcctcgatgcccttgtgacgggtctccaggtcggcgaagaggtcggcgagggtcgcgccctcaccggagacggccttctcgccttcggtgtaggtgcggaggatggtggggatgcggacctcgatggccatggctgtctccagtcgtcgggaagtgcgtcggaagcgtgaggcgtggaaagcgtgggaagcgtggctggcgtgagaggagtgcggcgcgcggttcgtcggcccctcgcgcggaggggctccggtgctcagagcgcgggacagatggcgctggcgagacggcacaggtcgacgtgcagccgcgccacgagcagcagcctgccgggcgtctcgatgctcacgtcgtgggaaaccatgcggtcatgttaacgattcccggtcccccgtttggagtgtgattccgcatcgtggacgtctgctgctcacatactgatcagtaggcgtcgacgacccgtacttcttcctcggtgatcacgccgtcgacgatccggtacgagcggaactggaactccccgaggccgtcctcgtccgccgtcgagacgagcacgtagtgcgcgccgggctcgttggcgtaggtgacgtccgtgcgcgaggggtacgcctcggtcgcggtgtgcgagtggtagacgatcaccggctcctcgtcgcggtcgtccagatcgcggtagagcttcagcagatcctttgagtcgaactcgtagaacgtgggcgagcgggccgcgttgagcatcgggacgaagcgctcggggcggtcggtgcccgccgggccggccacgacaccgcacgcctcgtcggggtggtcccggcgggcgtgctcgacgatccggtcgtgcaggtcctgggtgatggtcagcatgagcgacaggataagcagacgggcccccgcgtaccgaggagtggtacgcgggggcccgcatggtggacacaaggtccgtgggggcgcggttcccggccgcggcgggcggccgggaacggcggtcccggggtgctacgaggccttggtgaaggccgcgccgcgcgggtcgcgggacttcatgaccaggtaggagacgcccaggatcaggccccacagcggggcgcagtacagcgagacgcgggagtccttgtcggcgcccatcatcacgatgaccatgccgatgaagagcagcgcgaaccagctcgtgtacggggcgccgggggcgcggaacgcggactgcggcagctcgccgcggtcggccttggcccggtagcggatctggcagaccaggatcatgatccaggcccacatgccggagatggtggcgaaggagacgacgtagtcgaaggccttgcccggggcgacgtagttgatccagacgcccaccagcatcagcgcggcggagaaggtggtgccgacgagcggggtgccgctcttggtgagcttggtgaagaccttcgggccctggccgttgatggcgaggtcgcgcagcatgcggccggtggagtacatgcccgagttgcaggaggacagcgcggcggtcagcacgacgaagttgacgatcgcggcgccgatgccgaggcccatgcgctcgaaggcggcgacgaagggcgagacaccgggctggaagtgcgtccacgggacgaccgacaggatcatgatcagcgcgccgacgtagaagacggcgatgcgccacggcacggtgttgatggccttgggaagggtcttctcggggtccttggactcgccggcggtgacgccgaccagctccaccgcgaggaaggcgaacatcacgatctgcagggtcatcagcgtgccgccgatgcccttggggaagaagccgccgtcgttccacaggttggagacggtggcggtgtcggccgcgtcggagaagccgatggtgaggatgccggcgcagatcaggatcatgccgacgatggcggtgaccttgaccatggagaaccagaactccagctcaccgaagagcttcacggagatcaggttggcggcgtagaggatgaccgtgaagatcagcgcgtaggcccactgcgggaagctgtcgtgggtccagtacgacatgtactgcgcggccgcggtgacctcggtgatgccggtgaccacccagaacagccagtacgtccagccggtgacgtatccccagaacgggcccaggaactcgcgggcgtagtccgagaaggaaccggagacgggccggtacatgagcagctcgcccagggcccgcatgatgaagaagatgaccaggccggcgatggcgtaggccaggatcaggctgggcccggccttggagatcgccttgcccgcgcccaggaagaggccggtgccgatggctccgccgatcgcgatcatctggatctgacgggcgccgagcgtgcggtggtaaccctcgccgccctcgccctgtccgccctcgccgggcgtcttgtcgtgctgctcgacctgcacagaggtcatgtttggtgcgcctttctccacgccgacccgcgccttcgttggctgcggatcgggtcctcgatccccccggatacggatggagttgcacccggcggtctgccggttcaagcgggccgggagacatgggtggcgtccctgcggcggtcgtgaagatttatcacgtgcttacggctgccggagggggagaaatgtggcgcggggcatcaaaaattcaccccaaagccatgtaaatggatcagatcaccgcatggcggtgatctgatcgttatccggatttgagcgtccgctgagcgaacagtgttccctcttgaggattctcagagggtttcgatcaaggtttcctggagaccgccgagccagaggtaggccatcaccatcggcttgcgcgggtcctcgtccggcagccggaacagcatcgcgctctcgtcgtcctcggtgatgtcgaggcgggccgcgatggtcaggcgcaggtcgttgagcgcgccgagccagcgcagcggcagctcgccggacagctccagcaccgccgccccgtcaccggccggcgcgagtccgtccaggctgcgtacgaccgccagcgcgtcctcgcgcttgcgggcgcgcaggtcgttctcggtgaagcggcggaactccgacgagcgggccgcggtctcctcggggtccacgccctcgtcaccggccccgtcggggtccccgtacgcgtcggggaagagccgggccagcgccgggtcggacgggggctccgagggaccctcggcgaacagtgcggcgagcgggtcggcgtcctccgcgggctccggctcgccgggcccgatcagctccagcaactggacggacagggagcgcaggatcgagatctcgatctcgtcgagcgcgatggcggcgccgccgcccttcagggactcgaaggtgccgcccatcagttgcggtcctgggagagggtcgcccacaggccgtagccgtgcatggcctgcacgtcgcgctccatttcttcgcgggtgccgctcgagacgaccgcccgccccttgtggtggacgtcgagcatcaacttgtgtgccacgtccttcgagtagccgaagtacgcctggaacacgtacgccacgtagctcatgaggttgaccgggtcgttgtgcaccagggtcacccaggggacgtcgggttcggggaccgcaaaggtctcttcggcggattcggtgcgttcgatctcaacaggagcaacactcactcgtcccatgctgccatctcgaccgcgccgccgcccaaacagtggccgcgcggccacgaccgcggtgcggaccgcggctcgcaccgcggagggttcccgctcctcccgacggcccgggcgcacgatcgacacctacatctcgtcagtttgacgaaatgtgcgctagcatcccagccatgaaccctgcggacctgggcctgccggtggacgtgccgtcgacagcgctcttcacggatcattacgagctcacgatgctgcaggccgccctggccaacggcaccgccgaccgacgctcggtcttcgaggtgttcacccggcggctgcccgaggggcgccgctacggggtgatcgccggaaccggccgggtgctggacgcggtggagaacttccgcttcgacggcgcggtgctggaattcctgcgcgagcgggccgtcgtcgacatgcggacgctggactggctggcctcgtaccgcttctccggcgacatctggggctaccaggagggggaggtctacttccccggctcccccgtcctgcgggtggaaggcagcttcgccgagtgcgtgctgctggagaccgtgatcctgtcgatcctgaaccacgactcggcgatcgccgcggccgcctcccggatgtcctcggcggcgggcggacgcccgctgatcgagatgggcgcccggcgtacgcacgagctggcggccgtcgccgcctcccgggccgcgtacgtgggcggcttcacctcgacctcggacctggcggccggattccggtacggcatccccacggtcggcacgagcgcgcacgccttcaccctggtccacgacagcgagcgggacgccttcaccgcgcaggtggactcgctggggcggggcaccaccctgctggtggacacctacgacgtggccgaggcggtccgtacggcggtggagatcgccggaccggagctgggagcggtccggatcgactccggtgacctgctgctggtggcccaccgggtacggcagcagctcgacgagctgggcgcgacctcgacgaagatcgtggtcacctcggacctcgacgagtacgccatcgcctcgctggcggcggccccggtggacgcgtacggcgtgggcacccagctggtgaccggcagcgggcacccgacgtgctcgatggtctacaagctggtcgcgagggccacctcggccgaccccaaggcggcgctggccccggtggcgaagaagtcctcgggcggcaagacctccatcggcggccgcaagtgggcggcgcgccgccccgacgcggacggggtcgcggaggcggaggtgatcggcgtgggacccgtccccgccgccctggccgaccaccagctcctgacccagctggtcaaggccggcgaggtgatcgcccgcgagccgctggaggccgcgcgggaccgccaccgcgccgcccgcgcgagcctgccgctgtccgcgacgcagctctcgcgcggcgaggccgtgatcccgacggagtacgtctgaccccgcgggtccgctgccggggctccgccccagtttcgggaaggggcggggtgggggaagagccccccgcagggcccgccgcagcacaccatcaagccgaagggcacgcgaaatgcaccgcgcactgatcgtcgtcgacgtacagaacgacttctgcgagggcggcagcctcgcggtcaccggcggagccgacgtcgccgccgccgtcaccgagctgatcgggcaggccacggccgggtaccggcacgtcgtcgccacccgcgaccaccacgtcgaccccgggtcgcacttcgcgcacccgccggccgagccggactacgagacctcctggcccgtccactgcgtcgccgggaccgagggcgtgggcttccacccgaacttcgcccccgccgtggcctcgggagcggtctcggccgtcttcgacaagggtgcgtacgaggccgcgtacagcgggttcgagggcgcggacgagaacgggaccaccctcggccagtggctgcgggaccggcaggtcaccgaggtggacgtggtcgggatcgccaccgaccactgcgtgaaggccaccgccctcgacgccgcccgggccggcttcggcacccgcgtcctgctggacctgaccgccgccgtggccccgcacaccaccgcacgggccctggacgagctccgcacggccggtgtgaagctcgtcggcggtcaggccgaccagactcccgcctaggcgggagactcccgcctaggcgccccctaggtgcccaggagggcccggatggggtgccagagctcctgcgcccggtccggggcgccgcgccacagcaggccgtccggatggtgcaggacggccgtcacctcgtccggcgtcggcgggtgcgcgttgccccgcaggtagaccgcccgcattccgaggttccgcagcctggtcagggcgcgggcccggttcgcggcgtgcaccagcacgcggacatttccaccttctccggacggcctcggcagtgtgagcgccaccaccacactgccgcccggcaatctcacgaaaccgccgcctggcatcgctgtcatctcccccgtcaataagaaactcgtaccgggcatctaaacgcgaacggccgccgcccgctagagggcgacggccgatcatgctttgacctgcggttttaccgagttacttcgaggaggggccaacctcgacggtcatgacctcaccgtcgtaggtctccttcaggatcttgatcttggtgttggtgtcagtgaccttcaccgatccggtcgggttctcgtcgtagtagtacttgcccttgtggtcgtcgaagaccaggttcgcgggcttcggcttcaggaacagcgactcaccgttcttgtgaatcgtgaacgcatccgtcgagtacgcgctgaaggtggcgtcgtacggctggatcttgttgcggagcagcgtgccgtccgcccacttcatgggcttggcgttggcgtcgatcggcaggatcagaccctggcccgggtggacgctggtgttgttgtccttctggctggtgtcccactgccagatgagcagaccgtcctggtacgggtagtgctcgacccagtccggcttggtgttgccgaagccgaagttgtacgggcccaccttgagggtggagtcgtacgagacgtagcggcggttctcggcgatgtagcgctgcgcgtactccttggagaagtcgccgccgatccgcgagaagcccttgccggtccagccgttgtcgccgttctcggcgccgtcggtgaacagcgcggagccgtccgcggtcagggagatggcatcggccgtgaagcccttgccgcccgcgccgccgtccgtctggtagcggaagcggaggtcgaccttcttgcccgcgtaggcgtcgagcgggaagttcaggttcttccaggcacccgagacaccggtgagcgacgggctgccggaggcgtcggccgggatggccgtgccgtcggcggtgccggcgagcgcggtccaggtggcgccgccgtccgtggacacctcggtgtagaggtagtcgtagtcggcctcgatgtcccaccagcccttgagggacagggcggcggacttcttgccggtcaggtcgaccgagcgggtcagggtgttcttgaggtcgtcacccatgttgctccaccactgggtggagccctcggccggcttgacgacctcggtcttgacctgcttcttcggcagctcgacgacgagcgcctgcttgtccttggtgttgaactccgccacacccagcttgtgggtggacttcgtcgcggccttggccgtgtcgtagttcagccagcccagctggagcttgtcccaggcgttcatgtcgcccgggaggtcgccgatggagtccttgcccttgccgagccaggaaccggccgacatgagggaccagaagccgacgctgttctcgccgccaccggtggtgtcgtagaggtccggcagaccgaggtcgtgaccgtactcgtgcgcgaagacaccgaggccgccgttctcgggctgcatggtgtagtcgccgacccagatgccggtgttgccgatctgggtaccgccggccttgttgttgtccgggccggtcttgcccgccgcggtgccgtaggcgtaccagcggtgcgcccacagcgcggtcgtgccctgaacgccgccaccggccgactcgtcctcgcccgcgtggacgatctggaagtggtcgatgtagccgtcgggctcgttgaagttgccgtcgccgtcgaagtcgtagcggtcccactggtcgtactgggacagctgcgccttgatctgcgcgtcggtcttgccggccttcttctgggcctccgaccatgcggtgacgccgtccttgacggtgtcccacacgttggagcagttggtctggccgcagtagttggagccgtaacggccctcgttgtacgggaccttgacccagtcggcgacctcgccctcgaccgagtaacggcccgaggaggtcttctcgtagtaggtcttcagggagtccttgccctgacccgtggcgaagtacaggtcctggaagtactgacggctgaagtccttgcgccaggcggtgctgttgtccttggcgcggtccggctgggcgatcgtgttgtgcagcggaccgggggtaccgccgtacttggggacctcgggcttggggcccgggccgtccgggtcgaacatggtcgtgttgtcgacctggtcgccgaactcgacgaggatcgtgaagatcttgtcggtcttctcccggccgagctcgacgtacttcttgtcgtcgagcttgacgaccttggaggcgccacgctgctcgacgcccttcttaccggacaggacctggtccagggcggcagcgcgctgcttggcctgctggtcgctgaacgggcccttgaggtcgtgctcgacgaccttggcgggcgcggtcgggtcctgccggtcggccgccggggcggccggagccttcccctcggcctgagccgcggtgacggtgaagaaggtggcgcttgtcgcacaagcggccatggtcacggtgacagcggcagcgcgtatcgcacgccgtctggcggaattgctggtcacttgatgtcgttcccctcccgcggccgcaacgttggtcggaacttctccataggagcggggggttccgcgcggcgcgcgtctcaagtgacgacatttgaccggagggaagcaagaaaagacagaccttgacttgacccttacaactgcactatgcggtcagggagttccggtatccggacgttccgcagccatacggggcgaagggcgcttcccgaccccctcggtggtccgtcccgtccccctttctccccctgctgtcgcccggaaaatgaacccgtgcgccccccgtgctccggcaccgtgtgttaggtcacgcttaccggcggtcggactcgggcatctcccgtcatagagtcacttgacgcgcgaactggttgagccgactcccctcccctcaccgaggacggatatcgccatgccgcgtccgactgccgcacagctcgcgtacgggtccgccacggtcgtcgtgtcgacgatcgccatgctgttgctctcgcagacgagcaccgggatcggcgtcgcggtcatctccgccgccgcgctcgccctgggtctgctcgtcgcgctcaccgtacccatcccgcggcgccgtggccgccacgcggcgcgtacgggcgcctcccggtccgccgggtcccccgcggcccgggagggcgcgacagaggcctcccgggtgcccgagccccggaccgcgacggccgaacaccccgtacaccactgagcgttgacgccgcacgccacgcgggcggcctccccggagggacggccgcccgcgtggcgatgcgtcatgtctcggtcgtgcccgcacggctcagcgcgtggcttggaccaccacggtcttgccgaccttgtcgtgcaggccctgcttgtagggcttgtcgaccaggatggagacgatcagcgcgagcggccacaggcaggcgcagcagatcagggtcggcagccagagcacggcggcgcgcgtcagcgaggcgttggagttcggcacgctgccgtcgttgagcatcgcgacgcgcaggctcatcgccttcttgccgacggtctggccgctcttcttggtgaaccaccagtcgtaaccgacgtacgcgacgatcgagatcaaggtcatgatcaggccgctgccgctgtaggacttgctgaagacctcgccgatgtcctcgccctggttggtgtcgaaccggtagcggcccgtgccgaaggccagctggatgagggccagcgggatggcgacgatcacgatgtcgatgatgcgcgcgaggagccgcttgccgaagtcggcgagcgggggcatcccggcgagcgggtcgggcatgccgtagccgccgctcccgccgtacgggtcccctccgccgcctccgtacgggggcggcggaggcgggtatcccccgcctccgggcgggcctccgggcgggggcgggggacccccgctgccgggaggcggcgagccgtacggcgaaccgcccgacggaggcgtcggttcctggggcttcttgaggaacgggtcgtcctcgggcggctggcccggcggctggtcggtgctcatggcccgagtcgaacccggctccggcaccctcgcaacgggacagcgtccattcggggggaggggcgggcccgggcccgggtcggggccctcagaacgcgctcagcgggccacgtacgtgcgggccgccttgtcgtgccaggcctggcggcgcgggcggtccacaaggcaccagaggctgcccgggaggccgaggaaggcgtacaccagccagcggctcagggccgcgccgaaggtgggcggacacagggtggcggtggccaggacccgcacgcccagcagcttcttcccgggggtgcggccccagcgggcggtgggcagcacctcgtagaggatcccgaagaggaggacggcgccgaggaccaggcccagccggccggcgatggtctcgtcgaggagccagacggtggtggtgcgcccgctcgcccgtgcggcgtcgaccttggcctcgacgtgggcggtggcgccggggaggaggggcacggccacggccaccgcgacggcggcgtggacgagggagtccagggcgcgggccacggcccggcgcggcagcccggcggggcgcacggcccgctcggccatgcgctcgaacacctcgcggggcgtacgggcccccgcggggcgggagccggagccgcccgggcgggcctccccgggcccgcggggctcccggccctgcggctggggttccgccgaggcggccgcctcgggcagcggcgtgatcctcgggcgcactccggcggggcggggcgcccacacctcgggccggtcggcggccggggcctcgggcacggcgggggcggcggcacgcggccgggacggcgcgggggcgggctcgtgcgccggggtgggagccggcgcggggcgcgcgggcgcgggtgcgggagccggcgcggcggcgaccgcctcgggccaggaggaggtgagcccggagcggccggctccgggggcgtcgggccacgccggggccggggcaggagcggcggcgggagccggtgtctgggcggccggggaccgcactgacaggatccccgcggaggcctgcccggggagtctcgagggggccgcggccggcgccgccgcggcggccgcggtacgggccagggagatgcccgccgaccgcggggacggttccggtacgggctcgggctcgggctggggctggggctcaggccgtcgtacggactgtggagcggcatgcgcggcgggttccggatctggcgtgctgccccaggacacccggtggtcgcggggcccgccgaagccggcctggtgcacgggatcggcctgccacaccacaggctcggcgaacgcctcggcgacggcggccggggcgggggccggggcgggtgcgggggcgggggcgggaacgggctccggcagcgcctcggtcatggaggtctcgtcgaggaacaccggccccgtctcctgcgcgcgcagcgcgtgcccgccgaggacggcgggtgcggctggtgcggctggtgcggcgggtgcggctggtgcggcgacgggagcgggcgcgggcgcggcctgcgcggcgggcgccgactgcggggcagggcggctcgtacccggaacccaggccgctccgttccagtagcggatgtaccccgggatggacggatccgggtagtagccctcgcgggccgcgtgctcgccgtcaccaggggaggccgtcatgtccccaactccgatcgtggcttgaggcttgtgcaagggaggaccatagccaagaaccgccccccgacaggtccggtaacgggagaatccaagcaaacgagcgaacgtcaccctgcgcgatgcttttcggtcagccgaaagaaacaagccaatctccggttcgctgcccgaagtcgcgtcatacccgggcacactgccgctctctccgggtgtggggccccgtccggccccgcgcaccgaaccgaagtgaggccgtcatgcaccaccccgtcatcgagcgcgagctggaactgaagctggtcctgtcccccgagcgcagcatccccgtccccgcacggctcctctacctgacgcacgacccgtacgccgtccacatcaccttccacaccggctcgaacacccccgtgaactggacgttcgcccgtgagctgctggtcgagggggtgttccgcccctgcggccacggcgacgtccgggtctggcccacgaaggtcgacaacaaggccgtgctctgcatggcgctcacctcccccgacggcgacgccctcctggaggcccccgcgagctccgtgtcggcctggctggagcgcaccctgcgcgtggttccgcccggcaccgagaccgagcgcctcggcctggacgacgcgctggccgagctgctgaccccgaccccggccgacgacctgtggctgcgcgacccgtggccgtcggacgagtcggcggacggggacctgtgatgccgggcgaccgcacgccgggcagcggcactcggcacgaccgcacgccgggcgggccgcgccgggaggcgtcagaagagcttgcccggattgagcagcccgagcgggtcgaaggcctgcttgacggcccgctgcatctccaggcccaccggcccgagttcgcgggccagccactccttcttcagcacaccgaccccgtgttcgccggtgatggtcccgcccagggagaggccgagcgccatgatctcgccgaaggactcgcgggcccgccgcgtctcgtcctcgtccgcgggatcgaagcagacgatcgggtgggtgttgccgtccccggcgtgcgcgcagacgccgatgagcaggtcctgggcgcgggcgatggcggccgtgccgtccagcatctcgccgagccgcgagcgcggtacgcacacgtcgtcgatcatcgtcgcgggccgcagcgcctccagcgcggggaaggacatccgccgcgcctggagcagcagttcggactccgcctcgtcctcggcgggcacgacggcggtggccccggcggccgtgcacagcccgcccacggccgcgaggtcctcgggggcgtgcggggtgtcgaaggcggccagcaggagggcctccgtggcctcgggcagccccatcttcccgagggcgttgacggcccggacggtcgtgcggtccatcagttccagcagcgagggggtcaggcccgcctccatgacggcgcagacggcctcgcaggcggccgcgaccgaggggaactcggcggccagcgccagctggcggggcggcgcgggccgcagggcgaggacggcctggacgaccacgcccaggctgccctcggagcccacgaagagccgggtgaggtcatagcccgccacgcccttggcggtacgccggcccgtgcgcagcagccgtccgtcggccaggacgacgtcgaggccgagcacgtactcggcggtgaccccgtacttgacgcagcacaggccgcccgaggcggtgccgatgttgccgccgatggtgcactgctcccagctggagggatcgggcgggtagtacaggccctgttcggcgaccgcccgtgagaggacggcgttgaccacgccgggttcgaccacggcgatccggtcgacggcgctgatctccaggatccggtccatcttgacgagcgagagcacgatgcagccgtcggaggcgttggcgccgccggacaggcccgtgcgggccccctgcgggaccacggggatccgtagggcggtggcggtgcgcaggacgtgctggacctgttccacggtccggggcaggacgacggcggccggggtgccggcggcgcagaagctggccatgtcggtggcgtaggaggtggtcacctggggatcggtgagcagggcctcggcggggagcccttcgagcaggccggcccgcagacgtgcgaagagatcgtcatccatgggaccagcgtggcagccggggccatcggtgtgaacacgaccgcgctccacttcggacacctcggcgagctcttcatattgacgcacagtgaccccatggaccgtatcgacgaggaatcgcagacgccggcgccgcccgtgaccttcaccggccgcaagacgctcgtggcggccgcggtcgccgtggtcctgatcgccggggccctgctgatccggcccgccaggaccgctgacgacgcccggccgccggagccgggcgagcgtgcggcgtcggcggtgggcatgggcgcgcctgcggcggcggtggacctgacggcgctggtggcggaccgggagaagtggctcgcggcgcatccggacgatgacgcgtcgtgggccgtgctcggctccgcgtacctcgaacacgcacggcggacggccgattccggctggttcccgaaggcggagaaggccctgaaacgctcgctggaggtacgccccgccgagaagggcaacttcgacgcgatgacgggcatgggcgcgctggccaacgcccggcgggacttcgggaccgcccgcaagtggggtgagctcgtccgggcgcaggcgcccaagcggtggacggcgtacccggtgctggtggacgcgtacaccgggctcggcgactacaagggcgcgcagaaggcgatggagctgctgctggacatgcggccgggcctggccgcgtacgtcagggcctcgcaggtctaccgggaccgtggctggcgcgaggacgcggtggtggcgatggagcacgcggcgggcgcggcgaagaccccggcggagaaggcgtacgcgctgttccggctcggggagctgtcctgggagcggggcgacgcgggcgaggcgctgcggcagtacgagggcgcgctgcgcacggatccggcgcaggcggaggccctcggcgggcgggcccgcgcgctggccgcgctgggtcgcggcggcgaggcggtacgggactaccggatggcgctgggccggtccgcggtgccgcagctggcgcgggagctcggcgagctgctggactcgctggggcgggggcaggaggcgcgcgcccagtacgacgcgctggccacgatgacggcccgggacagcaggaacggggtcgacgacgcggtggtcctcggcctgtacgaggcggaccacggcgacgcggcggcggcggtacggcgcctgtcgcaggagtggtcgcggcacaagagcgtgcaggtcgcggacgctttggggtgggcgctgcaccaggcgggcgaggacgcggcggcgttggagtacgcgaagaaggccacggaaccggggctgcgcagcgccgacttcgcctaccaccgggcgatgatcgaacagggcctcggcgacgaggaggcggcccgccggcacctccaggaggccatgcggacgaacccgcacttctcgccgctgcgcgggccgctggcgaaggaggccctggcgtcgatcgcccagccggcgccgggaggcccggagaacatccggccgaccgcgccgtgggtggaaccggagttcccgaagccggcgaagccgacgccgacgccgtccccgaagccgacggggcgctgacggcggtacggggcggaaccccggagaacacgaaggcgccgcacccgggaacgggtgcggcgccgggcccccctcgggccgtgtcgtgcagacccgctgcgcggtgcaccttaagcggtgcgggcagcgcgtcgaaagccgcgggccgagccggaggctagaggttgccgcgcttgtcctgctcgcgctcgatcgcctcgaacagggccttgaagttgcccttgccgaagcccatcgagccgtggcgctcgatgatctcgaagaagacggtcgggcggtcctgcaccggcttcgtgaagatctgcagcaggtagccgtcctcgtcgcggtcggccaggatcttcagctcgcgcagctcgtcgatcggcacccgggtgtcgccgacccactcgccgagggtgtcgtagtaggtgtccgggacggacaggaactggacgcccgccgcgcgcatcgagcggaccgtcgagacgatgtcgttcgaggccagcgcgatgtgctggacaccggggccgttgtagaactccaggtactcgtcgatctgcgacttcttcttcgcgatcgccggctcgttgatcgggaacttgaccttcttggtgccgtccgcgacgaccttggacatcagcgccgagtactcggtcgcgatgtcgtcgcccacgaactccttcatgttcgtgaagcccatgaccttgttgtagaacgcgacccactcgttcatccggccgagctcgacgttgccgacgcagtggtcgatcgcctggaaggtgcgcttggccgggggctcgaccatcgggtcgacggcctcgtagccgggcaggtacgggccggtgtagtcgccgcgctcgaccagcgtgtggcgggtctggccgtaggtggcgatcgcggccagcacgaccgtgccgttctcgtccttgacctcgtacggctcgtccagtccgcgggcgccctgctcgacggcgtacttgtacgccgcgcggacgtccgggacctcgatggcgaggtcgatcacgccgtcgccgtgctcggtgacgtgctcggcgaggaagcggccgtggtcggtcgtcgccttgatgaccgaggtcagcacgaagcgcgcggagccgttggtcaggacgtagctggccgtctcgcgcgagccggtctccggtccggagtaggccacgagcttcatgccgaaggcggtcgagtagtagtgcgcggcctgcttggcattgccgacggcgaagacgacagcgtccatacccttcaccgggaaggggtctgcctcacgcgccgtgtgcggggtggtttcgaggttcgccagagactcagtcatgagcgcagagtcccgccgttccacaagctgcgcaatagtttccagtttgactgtacaaactgcccaggatgaccgcaggctgtttgaaacatctgtgcactatgaccacccgcgggcacgcgtgggcacccggaggcatccatgggcatcgacgaactcgacggccggctcatcgtcctgctcgcccgcgagccgcggatcggggtcctggaggcctcgcgccggctcggcgtggcccgcgggaccgtccaggcgcgcctggaccggctccagtcgaacggggtcatccgcgggttcggcccgcaggtcgacccgacggccctcgggtatccggtgaccgcgttcgcgacgctggagatcaagcaggggcagggggcggacgtacgggcgcacctgaacggggtgcccgaggtactggagctgcacaccaccaccgggcacggggacatgctgtgccggctggtggcccgctccaacgccgacctgcagcgggtgatcgaccgcgtcgtcggcttcgaggggatcgtgcgggcctcgacggcgatcgtgatggagaaccccgtaccgctgcggatcatcccgctggtggagcaggcggcggaggacgacacccgcccctgaggccgggctcccggcccgaggccccggcgggacatccaaagaagacgttgcaaagaaacccttgcacagagatctttgcaactctatcgtcgagtcatgcccgagacgcccgcagagcccaacgtccgtacgctcgacgcccgttcgctgcgcggactcgcccacccgctgcgcatccgcctgctggccgccctgcgccacgacggccccgccaccgcctcccggctcgcggaccggctcggggagtcgagcggggccaccagctaccacctgcgccagctcgcggtgcacgggttcgtcgaggacgcgcccggacacggcaagggccgcgagcgctggtggcgggccgtgtacgacggcacggccttcgacgagaagctgaccctcgacgaggacccggccgtgcgcggcgcggccgacctgttcctgcacgagatcgcgacgatccacacgcaggagctgagcacctggctcggcaacgcccacaactggccccgggaatggcggcgcggcgcggacatgagcgacttcaccctgcacctgaccgccgagcagagcctcgaactgatccacaagatgcacgacctgatcaacagctatcgggacctgcccgcctcggagggcacgaaggcggtccgcttccacacgcacgccttcccgcgcgaggcgtcggagtagccccactcccctgtcccccccgttcgtcctaggagtcctgccgtgcacgccttaatccccgacggaccgccgcgtgcggagcgccgtacggacaagcgcccgctggtcggcgtactggccgccaacaccatttccatagccgggagttcactcaccctcatcggcgttccgtggttcgtgctccagaccacgggcagcgccggccgggccggggtcgtcgccttctgcgccaccctgcccgtcatcgtggccgccctggtcggcggaccggtcatcgaccggatcggccgccgcagggtctccgtcgcctccgacctgatcagcggcctgtcggtcggcgcgatcccgctgctgcactacgccggcgtgctggagttctggatgctgtgtgcgctgatggccgtcggcggcctcgtgcacaccccgggcctgaccgcccgcgccgtgctcctgccgaacctcgccgagcacgccggcaccaccatcacccgggccgccggcctctacgacgcggtctcacgcggcgcccggatgatcggggccgcgggggccggactgctcatcgcggtgttcggtgccgaaacggtgctgctgctggacgcggcgaccttcggggcgtcggcgctgctggtcaccctgttcctgcgcggggtgccggccgccgaaccccagcgcaccgccggcaaggtgtccttcggggcctaccgcgccgaactcgccgaaggctgggccttcatgacccgcacccggctgctgctgggcgtcacggtgatggtcatgatgaccaacgggctggaccagggctggtcctcggtcctgctgccggtgcacggccgggaggacctcggcggcgccaccgcgatcggcctgatgatctccctgttcggcggcttcgccctgctgggcgccctgctctacggcatgtggggcgagcgcttcccgcgccgcgcggtgttcacggccgccttcctgctctccggggcgacccggtacgtggtggccgccctcaccgacacgaccctgccgctcgcggtgacgatggccctggccggactgggcgcgggcatgctcaacccgatcctgacgacggtcatgtacgagcaggtgccggaggcgctgcgcagccgtgtctcgggcgtggccacggctggctgcgagctgaccatgccgatgggcgggctcgcggcgggcctgctggtcgacgggttcggggtcaccaccgcgctgctgctgttcggaggcgcgtacctgctcacgaccctctccccgatggtcttcccggcctggcgcggactggacgggccgccggccgccggcgtcagcaggacggagcctgctcaccccggttcagcgcgcgaagagagttcaccgcatccgtcagcgaggtgacggggaccagccgcagtccctcggggagttccgacagggcgtccgcgcactcggccttcggtacgaggaacacgctcgccccgtcgcgccgcgcggcctgggtcttcagggccaccccgccgaccgcgccgaccgtgccgtcggcggtgatggtgcccgtaccggcgacgctgcggccgccggtgagatcgccgccgctgccgtcaccgtcgagcttgtcgacgatgccgagggagaagaggagtccggcgctcgggccgccgacgtcggcgaggttgaggtcgaccttcacgtccttggggtccttgtggagaaagccgagggccgcgtcggtggcggccgactgcgacttggccatttcctccaggttgtgcttctcgatctcctcgtcgcttccgcccgtggagtagacggcttctctgggcatgaccgcctgatcggtcttgaaccagtgaccgatgagctcgtgcagcttcatggtcgaggacggaccggtggcccggatggtggtcatgcgcagctcgcccttggtgtcccggaccggggcgccggtcacggtgatgaccggcttgccctggtcggagcccagtacgtcggccgtgagcccgggaatggcgaccacgaagggcagcggcgcgaaggccgcggcggcgaacagcccgagcacgggcacggcgcagacggccagggcggcgggacggggcagacgtgtgaggcgtgaaagcacccgcccaatctatccgccccctcacccccaccggcgtccgaggcgctcgttcagccccgccgccgtttgaggcgcgggggtccgggggcagcacccccggcaacggcgccgcacccggcatccgcgatccgccgagcccgcggctagcgaagggcgtcggccacttcccgcgccgcgtcgaccacccgcggcccgacccgctccggcacggcgtccgccagcatgacgacgccgacgctgccttccagcccggtgatgcccacgagcggcgcggcggcgccgctggcgcccgcttccagctctccgtgggtcagcgtgtaccccggctcgatcaaggagccctggcgggccgccaggatggcccgcccggcggccccgcggtccagcgggtggcggaagccggcccggtaggccacgtggtagtccgtccaggtcggctccacgacggcgacagcgagcgcctcggtaccgtcgacgagggtcaggtgcgcggtggcgcctatgtcctcggcgagggaccgcagcgcgggcagggcggcctcgcgtacgagcggatggacctgccggcccagccgcagcactccgagaccgacccgggcccggccgccgaggtcacggcggaccagggcgtgctgttcgagggtggcgaggagccggtagaccacggtgcggttcacaccgaggcggttggagagctcggtgacggtcagaccgtggtcggtgtcggcgagcagtttgaggactctgagccctctgtcgagagtctgggaggtttccgcggtcacgacgcctcgccctctttcggtgagcggcggtgactctcggggcggcacgtcgccggtcccgcggcgacgcacggagaggccgccggtagcggccattgcaccggctgcgctcccgcggcggcgctgccacggtgcgtttgatgcggggacagtagcgagcaggttcgctcagcggaagggctcgtccagaatccgggcgcgtgctacctgtttatgccgtttcctgatcggcctcggtgtcaattcgtgaccccgattgccacaggaggcctttaccgccgcattgctccgagcatgttcaaaacgacggtgatcggctccccaccccgccgcgtcacgccggacggggtccgtgcgaacctccgcacggaccccgtcccctgctcccgatgaactcaccgcatccgggtggcccactcctgcaccttcttgatccgctcgcgcagctgccccgcggtcgcctccgcactcggcgggccgccgcacacccggcgcagctccgtgtggatcaccccgtgcggcttcccgctctggtggacgtaggcgcccaccatcgtgttcagcgacttgcgcagctccagcagctccttgtgcgagaccacgggccgccggtcggccggcagctccagcaggtccgcctccgcgtccggcttgcgccggctgtgcgcgatctgccgcgactgccgcttctgcagcagcatctgcacctggtccggctccagcagcccggggatgccgaggtagtcctgctcctcctcgctgcccgggtgcgcctgcataccgaactcggcgccgtcgtagaggacccggtcgaagaccgcgtcggactccagcgcctcgaaggacatctgctcgtcctcgccggtgtcctcgtcctcctgcttgttcgcctcgtccatctccttctcggactcggcgtacggatcctcctcgccctgcttcttcggcttgtcgaggacgtggtcgcgctcgacctccatctcgttggcgaagccgaggagataggggatggtcggcaggaacacggacgcggtctcgccgcgcctgcgcgatcgcacgaaccggccgacggcctgcgcgaagaacagcggcgtcgagatggtggtggcgtagacgcccaccgcgaggcgcggcacgtcgacgccctcggacaccatgcggaccgcgaccatccagcggctgccgtcctcgctgaactcgtcgatccgcttcgacgccccggtgtcgtcggagagcaccacggtcgccttgctgccggtgatctcccgcagcagcttggcgtaggcgcgcgccgagtcctggtcggaggcgatgacgaggccgccggcgtccgggatgcccttcctgacctccgtcagccgctggtcggcggcgcgcagcacgttcggcatccagtctccgcgcgggtccagcgccgtgcgccaggcctgggagatggcgtccttggtcatcggctcgccgagccgggcggcgatctcgtcgccggccttggtccgccagcgcatgttgccgctgtaggagaggaagatgaccggacggaccacgccgtcgccgagcgcgttgccgtagccgtaggtgtagtcggcggaggaccgccggatgccgtcgttcccctcctcgtacgtgacgaaggggatcgggttcgtgtcggaccggaagggcgtgccggtcagggccaggcgccgggtcgccgggtcgaaggcctccaggcaggcctcgccccaggacttcgagtcaccggcgtggtggatctcgtcgaggatgacgagggtcttgcgctgctcgcagcggttgcggtgcagcatcgggcgcacgccgacaccggcgtaggtgacggcgaccccgtggtagtccttgctgagcggtccggcggagtactcggggtcgagccggatgcctatccgggccgccgcctccgcccactgcttcttcaggtgttcggtcggcgcgacgacggtcacctgctgcacgacgtggtggtgcagcagccaggaggcgagggtgagcgcgaaggtcgtcttgccggcgccgggcgtggcgaccgcgaggaagtcccgcggctggttctggatgtagcggtcgagcgccccctgctgccaggcacgcagcttgttggcggtaccccagggggcacggccggggaaggcgggtgagaggtggtgggaggcggtagtagtcacggtctccggttcgtgctctcggcgtatctggtacgggtggcaggcagtcgtacgtaggacaaccgggccaccctaccggcccggacccgcccctcgcggagggacaggcccgtgacctcggcgggtgcggtgagcgtcacatcggcggggcgagcagcgcccgaagccgcgcggcgatccgcgcgatgtcgctctcgtgaccggcggccacgtcgacgaccagcccgtaggccgcctcctggtcgacgtcgccgggatcggccccgttcacggcgaggaaggtcgccgcggcgagccaggcggtgcgcttgttgccgtcgaccagcgggtggttcgccgcgatgccgtggagcagtgcggcggcctgctcgtacggatcctcgtacgccggggtcccgaacatcctcgcccggggccggtgcacggccgactccagcagcccgggggcgcgcagttcgacgggctggtcctgggccaggcaggcgtgccgggccaggtcgaggacctcggcgagcgtgaggtggcgcaccggggcggtggcggcgctcatgcgccgagccgcttcagcaggggagcgtgccgctgcgcgagccgcagcgcctgggccccgacccggtcccgctcggccttcagcagtgcccgtacggcgtcgagcgcgagctcctcgggcgaccggcccgtcgcgtcggcgaggtcggcgcattcctcgcgctcggcatcggacagtctgatgatcagctcgttcatggccgcaacggtagaacggccgcgggccgcgccgcagcggaattccgcggggcccggcggcaggcccgcgcggtcactccttgcggtcacgccttgcggccacggctcgggcggtcacgccttggcgggccacggctcgggcggtcactcctacgcggtcgctccttgcggtcacgccttggcgggatccagccgggtcgtgacccacgcccccaccagcgccacgcaggacatcggcaggaacaccgcggcgaacgcggccgggtgcgaggccgacgcgcccgcggtcacggtgtgcgcggcccccaccgcaccgcccccgagcgcggcgaacgcggcgcctccgaaggccagcagcaccacgttcgccagcgcgtccgagatctgcagggcggcggaattggcccccgcctcctccggcgccgacagctggagcagcagcacgctcgtggagccgatcaccaggcccatgcccaggcagccgaccgcccaggccagtgccagcgtccacaccggtacggactcgatcagcacggcgggcgccgcggcgatggccagcgccaccagcaccatcccgcacaccatcagccgttcccggtacggggccacccggctcttggactgcacccacgaaccacccgcccaggtcactccgcccagcgcgagcgagaacccggccatcgtcgggctcagcccgcgctgggtgaccagcatcagcggtacgaagctctccgccgcgatgaacgacccggcggcgaccccgcgcagcagcaccacggacggcagcccgcggcgcgcccggtaggtcccgcgcggcagcagcccgagcacggcgggcacgagcagggcggcgccggcgatgcccggcacgagcgagagccaccgcaggtcctgggcggcgtactggagcaggcccgcgcccaccgagatgccgaaggccagccggatccgccgccggtcgaaggccacggccggggcgtcggggtcgacgggcccggacgcggtccgccgtatcgcgggcagggccaccatcagcgggacgacgaccagagccggtatcccgaggaagacccaccgccagccgaggtgctcggtgaccgtcccggaagccagcggcccgacgatcgaggggaccacccagctcgcggcgaaggccgccatgatcgcgggccgcagccgctcctcgtacgcccggctgacgacgacgtagagggcgacgatgaccagcccgccgccgaagccctgcacggcgcggccgagcacgaacacccacatggccccggcggtcccggagatcacgagcccggaggcgaaggaggcgatgccgacggccagcggccgcagcggcccctgccggtcggcccactggccggacaggaccatgccgaagaggctggtggtgaagtaggcggagaaggcgaaggcgtagagcccgatcccctccagctcgcgggcggcgacgggcatggccgtgccgactgcggtggcctcgaaggcgatgaggaagacgacggagatgatcccgatgctgagcgtccggtacgcgggcccgagaaccccgccctgaggcgggggcggggccggtgcggttctctggggcacgcggggttcaagggcgctcatcgccccagagtaaggtgcgtagccccggagtggccctgtcaattcgacggatcccgttctggtcccgcggacctaggtcccccggtctgtgaacgcggcatggcagtcgcgttgcacggtccgcgatccccttccccacccccacggaccccccgtacggtcgtgcacatcaccaccccacagccgtgtgcccgagtggttgagggactcgcctgcaaagcgagttacgccggttcgattccggtcacggcttctggatgcccgcccaggcgggccggaagggcggcacccccgaggggtgccgcccttccggccgtctctcggccgatgcccggcgggtcggcacaggtacggtccctgcgcgggagaggggcagtggtcagtcgacctgctctccgtcgtgcgtaccgcccttgcagaagttgcccgcgtcattgatcgcgggcgttccgccgccctgcttgcactcggaaggtgtgacgtaggacgaggcgccctgcgtctgcgtggtggcggcggtggctgcggcggcgcctgtgaggccgagtccggcgagggctgccgtggcgatgacggcggcgaggattcgtcgaatgcgcatgtggttcccctttcacggattgcctcgatcggggcgctggtcagcttgatccgcacccatgtgggcggcgcgtcatggcgcgccgttcgggtgccgggtcggtgacacgacccgtcgggcaggctctggatggctgggcctgcgctctctattccaagctagcaatttccgcaaatgggcgcattccggtggtgtgcaccctgcgctgacaccgcgcggccatggtggtggtcgactaccgccatgagtccccgctcacagcttcggcgggtccgaagccggacgggcgtgcgggactgaactggggtgaacgaacccgcatttggctcttgcgaagcgacgtacgccggaccgacccgcgcgagggcctaccggtccagttcgccggctgctgccggcagtccaccgttgttcgcgcatcccagttcacgggacaccgccagtgcggcggagtgggcgaccaccaagtactcgtccaccaggcccgaatcgctttcgagtttctgccagcggttcgcgaagacgcccgtgatccgcaggggcacgtcggcggtggagccgacccgggtgctcacgcagtcgaacgacaccccggcctccttctcgcccggcagtacgcgcaccccgacctgatcggggcgcggcggacccgccttcccgctgtccgcggtcagacggatctcgcccatccggtcccctccgccgacctgcccggtcacggtgcaggaagggacggctgcctcacgcaccttcgggcccgccttgtacgccgcctccagggccttgcccgtcgccgccacgccgacggcctgcgcctcgtcccgcatgacggcggaggactggagcacccgcttgagcgcctcggcacccgccgccgacagcagcccgggacaggcgtccgccacttcgacggtgaccgacgtcgtggccgactccggggccgtcttcttcggcccggaatccggggaggagcacccggcggcggccagcgcgaggcacatcgcgaacccgccgatccgtgccgtccgtgccgtccgtatgcccggctgtcccatgccccgcccctgtctccggtacttctgctgccacaccgcccggcctgcgcggaaccgccgcccgcagggtgttgccgcctacgacttccctgctgcggacgccacctggtcccggcccaccgagtgggcgttcgcggtctccttcgaagccgcaccggccaggacgtcgatgtccgtggccgacatgcccgaacccgccgcggcgttgcggacggcgtccgccgccgccttgctcgactgggtctgcgcggcagagtacatctccgagacgtcctgctccgtcttgtcggtcttctcctcgccctccttcttggcgccctcgacgaagtgctcggtcacgtcctcctggacccactcgatcacatcgcccgccagcggcaccatctccaggtactttccgcccgccgcggtgatgccccgattgatccacttggcgccgtcctccacccccttgacgtactcctcgttgctgtgggcggtctcggcgtgcatgttctcggcgcgggcctccgtgagcatcccggcgatctggcctccggggtggacggcgttctcgatggccgtgtcgagatgccccgtgtcgccgcggtgcgcgatgacgtcgttcaccaggacggcggtgaacgcctggttggcgttggtgatcgccccgtacgcctccggatcctggccgaccgcccccaggaaacgcgccatgttcgacttgttgaactcggccatgtcgccgctgaccttgatctgcccaccgccgttctccgcggaggcctgcaggtccggcatgtactcggccgacatgttcccgagatggcccgacaggcccgccaggggggccttctcgtcctcgcccggcttggtcacgacgaggtccggatcctcaccgatcttctcgaccacccgctccatgactgccgtcatctgctcggtgtgcgccacgggcttcgcgtcctcgtcaccggccgcgcgccccgagaccgccgcctccagcgccccgccgagcgcgtcctgcgccggatggagggccccggtccggctgatgtcgaagctgtccatgtacggcttcttgtcgagcatgtagtcgaccatgccctggtccttgccgtgctgccccgagaccggcttgtcgttcttcgtgacgatgccgtccttgtcgctgtcctcgcggaccggctcgccgaagaaggccgtcgcggcgtccgggttgttgcccagcgcctccatcaggccggtcagcgggtagaagccacggccgtcctggccctggctgaggaccgagtccagctcgtacggggtgtggaactcccaggcccgcgggtccttgcggtccatggcgaccatgtcacggccgaccgaggtcaggaactccgtgtcgtacttcccctcgcgcagcagcgcgcccagggcctggtagccgtagatctgctgcacgccgccgtacacggccatctccttgcggcccgccttcatcagctgggtcgtccaggcggcgtcgaggtggttcggaacgtccttgtgcgtcgcgaggccgagcatcgcgcccatgtcgctctggatgttcgcgaccatcagcgcccggtccttgccggccggccccaggcccgtcgcgtcgagggacatccgggagtacatctccaaggtgccttcggcgccgatcgtccggtagaagcccgtggagaactcggggtccgtgcggttgtcgtcgagcagttcctccagctcgcgcagcgcctcgacgttgcgtgccgtgccgccctcgccggtgaccttcttcatcaggtcggcggcgcgggccgcctgttcggcatcgagggtggtgaacttcggtccgctgaagtcgtgttcgtccgcgacgttcgcccggaggacccggaccagggagtcgtcggcgtcctgggcgtcctcgacggctcggttgatccgggtctgccacgcgttgcgggccgtgttcacggtctgctggtagtcggggtcgtgccgggccgcgttccgctcaccctcggtgggcagcggaatggccgtgacccgcccgtcggcatcgacccggaagccggccgccggggcctccgcggcgagcttcttcagctcgtcctgggcggccttgaaggtcgcgtgcgcgtcggcgaggacctggtgcatgcccttggcggccttggccgcgtcctcgaactccttggccgtcttgtcgacgaacccgcgcgccacgcctgcggtgaccccgctccactcggccttgtcggacttcgccttcatgccgttgcgagcggcctcggccatctcgtccagcttgccggccatcgccgtccagtcggtgacggccgtctggagcttgcccaggggcgcgttcatcacgttctcgtacgtcagcatgaaggcgcctacttgaggagtttgtctatcgcggatgcggtgaagtccgcctggagctgctgctcgtccttggcgtgggaggcgagcgagtagttcagcccgttggagatgttggcgcaggcggccacgagggtcttcacctggctctcccaagcgctgttgaccttgagcagcgccgccccgctcgcgaagccctccttggtgagggccccggccgcctcggtggtggcggtgtcggcgtgcttgccgtcggtctgcaggcgcgtgtgcagcttgtacgcctcggagccgatcgcaccgatgtggtcctgattgagctcaaggtcaccgccaccaccgccaccgccgggatcggcgggcacctgattgaggcgcatggtgacaccggcggcggccgtggcgcgagccgccgaccattcctcgtcgaacgacatcgcgtgaactcccgaaggctggttgcagggtcagatcggcccgggtcagcggttacgtcgtacgacgaccacggtcacggctccaccgatcagcacgcaggctcccagaccaagggcgatccagggaagcacactgccgctcttcttgtcctcggcctgtgcggcgggcttggacgcggcggcgtcgggagccttgccgtcggcggatgcggagggcttcttggccgccgcatccgccgccgcgagatcgggcagcgggtacacgtcggccgggccggggtcaccgggcgtctgcaacgcgaccctgggccggacgatgccgtagccgacgtaatcgttgcgctcgacgccgtcggtgggcttgcccgcggtgttcaggagcacgcgcaggacctggttgttggtccagtcggggtgggcggaccagaggagcgcggcggaggccgaggcaagggcggaggcatcactggttccgtgggtcttacagacaccggacttggtcttgcaggatgaaacaatgtcgatacccggcgcggctatatctacctgggggccgtgcatcgactccttggtcgccttgccattggcgtccgcagctccgacacccactaccccgggagttccggcggggtaggcgagctcgttggtcgtatccccgtcattgccgacagcggcaaaaaccagcttgcccttcgagagcgcatacttcacggcggctgcccgccccgcgtcttgctctggcttactggggagccccatggaaatgttgatgaccttggcgtccgagtccgccgcgtagcgaatggccgcgacgatcgacggagtatccgcgccttccaacatgtcgggcacacggatcgggaggatcttgacgccgggtgcgaggccatacgcgccgtcaccgctcgggtgcttcccagtaccagcgatcattccggccatgccggtaccgtggccgtaatagtcgttgtctctgccgacctcggcgtcaccaaccggaaaagcctttcccgggagaacttgtccttcaagttccgggatctgattgacaccagtatcgatcaccgcgacggtgatccccttgcccgtggtgatcttccagatctcgtcggtcttcatggcgtcgagatgccattgctgcgctcgaatggtctccgcgtgggcgggggtcgcggcgaccccagccagcaggaggcccaccagggccgaggtcgccttacgcatgcgcatcccgtgcaacgtccgttctactcagtcgatcacaggcggaacaacgcgacggctgccctgccaggtctcttcgtcctcggccaggtagtcggggcgttcgccgccctgctcgtcctgccgcttacccggggtctgcgggcgtgcacccgcatgccccatggcgcccgcacccgcgccacccgcgccgttgcggacgaggcccgaaccgccctgggtgaacggctgaccacccgcaaccgtacgaccgaccgcaccggtctgacgccctccgacgacaccgcccggctccgatgccagtcgacgacctgccgcgaagccgccctggctgccgtgggcgccgccgccaccgtggcccattcctccgccgcccatggggcggcccgcctgggcgccttcaccaatgaccgtgccacgcgggatacccgagctggggcccgtcgacgtcacaggccgaccgcccatgatgccgctgtcacgcgggggcaatcccggcgtgccgaggaccttgccgccgggaggaggcataccgggaccactcagacccgggtacgggccgatacccggaccagtcaggccgggcggcttcacaccgccgaccggcgggaagcccatgggcggaagtacgggaccaggagtggggctgacgggacccgtaggcagcggaccaggggtgatcgtcactggaggcgcagtccggtccggaagcgtcgcaacactgtcgaggtccacatccacctcacgatccgggagcgacggtacatgcacagagggaaccgtgttgtccggctgtggcgaacggccggtcaccgacccggcatcgtccgaggacgtaccgtgcgacgagcctggcgtcgcgtacgacgaaccggccgagccgactccagcgctcgcccctgccccagacctcgccatctcttcagaaccgccgccgtcgtagcccttcggcacaaacaccggcggcggctccgggaacgtcgggatcggggccttgtccatctccgtcgacgactgctggtacgactgcgccaggttggtcatcaggcggatggcctcgcggcggtccgcgtccagcgttgtctgcgcctcggcgcggaccgtcgccgagtccgggtcgttgtggtgctcaagggccgacgcgaggttcttcgtcgcggtcgcgtcgaccgcggtcatcttcgtggcctcggtcatcgtctggatgacccagcccatcgcctcgccgcccttggcgctgtactcgctcagacgcagcgtcgcgttgccggcgcggcccacccactcctggaaggcgtcggctccttggccctcccagccggtcacaacgtggttcttgagcgcctcgccgatcttcttgatgtcctcggcggctttcttcagctggtcggaccgcgcctggaccgaggtggggtccagggaagcgatcatgtcgcgcatctgctggtgcgtgaagctttcaaaatcggtcatgagtagctacctcccgccgtgctgggcgacggagtcggagtcgtggacgtcggcggctggttggctgcctctaggcggcgcttctcctccggccacgggtcacgctccgccacgtaatgcgccttcgcctccctggcgatggccgccatgcgccgcttggtctcctcgtccacgccgtcgtagcccttgcccgccgacaggaccgcgatgcccagggcctcgatctgccccgccagccccttcgagaggttctgcagctgcgtgacgaccgtgtcgtacgacttgaacagcgcgtcgacctccgcgaagcccttaccgagcttgctggccggcagtttgccgtccgccaacttcttgtggtccgcgtcggagccggtgaggtcgtccaacaggccgtccaccatgcgcttgtactcgctcatcgagtcgaactcgacccgcagcgccgcactggtcgcaccgtaggccgcgcccgcgatcgcgcccatcggacccgccagccccagcgtgagggctgctgccacctggcccgccccgttgtcctctgccacgttggcctccccgtctccccgtctccccgtggtcgcggcgtctccgccgcgccccgtccccgttcgcacccgtgtccatgcgtacatggacacttgtgccgatcactctagcgaccggcaccgacaggcccaagtccggggttgcacgtgcaatgcgggtcacacggtcacgagttgggcgaacccaccgctgcggacggcctgatcgggagccggttcaccgggcggcccgtggccgcgcggaccgccgaggccaccgccgccggggtcgtcaccacggggaccgcgctcgccgccttcgctccgaacggggccaccacgtcgcgctcttcgaccagtttgacgatgcggaccgccggggcgtccagtgccgtcggcagggcgtagcccgtcaggtccgggtggcggatcaggccggcgaccgagcggaggttctccgtcagggccgcgcccacgccctgggtgacgcccgcctcgatacgggcttccagctgacgggggttcaggatgcggcccacgtcctgggcgaccgcgagttccacgacccgtaccgagcccagttcgatgtccacgtccaccaccgcgcggatcgcgcagaaggcgaggcccacgaaggcgtcgccctggccgtccgcgtcgaggggttccgtcgggtgggggcggcactgggccgtcgcccacagctccttgcccgccatcgcctccgccaccgacatcgagaacgcgccgtcgtacgacgtgatgcgcccgtcctggatctgcagcagctccgtcgacatgcccagcttgtgggccatcggctggaggagctgcgtacggaccatcttggccgcccgctccaccgcgccgcccgacacccacgtgtggcggccgtgcgccgatgggccggccggcggctggtcggtgtcgaccggggccatcgcgacctcgtcgacgcccagtacctcctggacgatctggcgggccagcgtggcgaagccctggccggtgtcgacggccgcgcagatgaccgtggccgcgccgcctacgaccttcaccgtggcggtggagacctcgtcggcgccctcggcgccgagcatgtggaccatgccgacgccgtagccgacgcctcgccgtaccgcgcccggctcgcccgcaccctccgggccgcccggcagcagccactcgtcctcgggggcgtccttcgggagggcggggagctcgaagtcgcggaccgcgcgcagcagttcggccaccggggccgggcaggtgaccgtctggccggtcgggaggaggtcgcccgtcgccaggacgttgcgcatgcgcagttccgcgccgtcgatgccgagggccgcggccagcttgtccatctggccctcgtacgcggcgcacacctgcatggcgccctcgccgcggacgtggcccgacggcgggttgttggtgcgtaccgcccagccctcgacgaaggcgtgcgggacgacgtacgggccgcaggcgaaggccaccgccgccgccagggactcggaggaggaatcggcgtaggcgccggcgtccatgaggatctgggcctcgaccttgaccagccggccctccgcgtccgcgtggtggcggtagcgcagcagggtcgggtgccggtgggtgtggccgaggaaggactcctcgcgggtggcggccagtttgaccgggcagcccgtacgcagggcgagcaggccgagcgggagctggaaggcggcgtcctcgcggtcggccgtcgcgcccggcaccccggtgacgacgacgcgtacgcggtccgggtccagcccgaagcaggcggcggccaggtcgcggtcggtgtgcgggtcggtggacgcggtgtagagctccacgccgccgtcgggccgcggtacggccagtccggcctcggcgccgatgggggcggggtcctggcggccgatccggtacaggccctccaccaccacctcgcccgtggcctccgggtcgccgtagcggagcgggatgtgccggatcaggttgccgtcggggtgcagggcgggggcgccgaaggactgctcggggtcggtgaccgggtcgaggagctcgtactcgaccgcgatcgcggcggcggcgagccgagcggtgtcggggtggtcggcggcgacggcggcgatgggctcgccgtggtggcgtacgacgtcgtgcgcgaacaccggccggtcggcgatccggcggccgtgcgtggtggcgccgggcacgtcggcgtgggtgacgacggcgcggacgccgggcatctcggcggcggccgtcgtgtcgatggacaggatccgggcgtgggcgtgcggcgagcgcagcacggcggcccacaggaggccctcggcccacaggtcggcggcgtaggggaaggtgccctcggtcttggcccgggcgtccgcggccgggacggaggccccgattccgtgcggggcccgctgttcggaggcctcggaacccgtggcggccatggccgtcaccgtggtgccgaccgttgtcgtcgccgtcgccgcgtcctgcccgctcacgccgtgcctccgtggtggatgccgccctcgccgggcgctgcctggtgcgggatgcgcggctccggtccctggcccggaccgccgggaccgcccggaccgcccgtgcccgcgttcggggccgcgggctccgcggccgccgcctcgcgctcggccacgacctcgcgcacggcgtcgacgaccccggagtagccggagcagcggcagaggttgccgcagagagcctgacgggtctccagctcgctgggggcgtgattgccctccagcaggtcgtggatggtcatggccatgccgggtacgcagaacccgcactgcaccgcacccgacctgcacaacgcttgctgcacgtccgagagttccccgccggtcgcgagaccctcgacggtgcggacctcgctgccggcggccgtcgcggccggtaccaggcaggaggcgacgagccggccgtcgacctgcacggcgcaggcgccgcactcgccctgcgagcagccgtccttggcgccggcgaggccgaggcgctcgcgcagcacgtacaggagggactcgccgatccaggcgccggtgaccggccggtcggcgccgttgacgcgcaggacgtaggaggccgacgggtgctcgtgatgggcgacggccccggcggtcgcttcttcctcgtacgccgccacctcggccgggagaccttcggcggtgccctggtccgggagagcaccggcgctgtcggcggtgtccgcgtccggcgtccggtcggccgggggctcctgctcggccggcccgtccccgctcgcggggccgggcgccggagcgacggcctccgcctcctgcgcggcgtcgtgcacggcgtcctgcgcggcctgggggccgggctccggagcgtggccgaacgcggtgaagccgtggccgtcggtaccgtccggctgcgcgggcccggcagccggcgcctgggcgcgcaccccgccgaagaggtccaggccggcgggagccgccggctgccgctcggcggcggcccgggcgtcgagggaggcggcggtgaagccgcggccgtccgtgccgccctgctccgcatacccggcgtactcgccctgcccggcgtactcgccctgcgcggcgtactcgccctggaccgcgtgccccgcgtgcccggcgtactcgccccggcccgcgtggtcggcggccctggcaccctcggcctgctcccccgccgggccgtgcgcggcgtcgatgtcgtgcggggcctggtgcaccggctcgccctcgggcagggcggtgcccaccccgggtccgcccagtacccgcggcccccgccccgcggcgcccacgccgggcccgccgagcagccgcccggcggcatgcgcggtcgcggcggcggcggccgaagcggcggcggcctcgtccgtaccggggagcacaccggcacccgcacccgcacccgcgtccgcgttcgggtccgcggccggctgctgcgtcaggtacgcccacggcgccggggcgccgcccggcagcgtcgccggggcctggctccagtcggcgtccagagcgcccggccggtagtcgttcggctgctcggggaattccccgaactcgggcacggcccactgtccggtcgccgggccggcctgctcgggctcgtgcgccgcctccgggaagcgccactcggcggtctcactcgggtcggtcaccggctgctccggctccgtctcggcgaacgccgccgcgaccgacgccgggatcgggatcgacgccgggatcggcccgcccacggacccggagccctggccctggcccgcaccggcggaacccgcacccgcggcacccgcgcccgccggatcggcctgcgtcgagcccgcgcccgcctccggccactgcaccggcatcgtccacgtccccgtggccgccggatccgtgctggccgagccgagcggcacgatcatcggcggcggcacgtagccgtgcccgggcgccgcgagcggctccccggtgccgagcgcgtccagcatgtcctgcggcagtttcacgaaggccgtggcgtccgagtcgtactcgccgccctgcgggaccggttcccagccccagcccgccgtgccgttcccctgggtcacgttctcgttctcgttctcgctcatgaggtcagtgccctccccagggccctgcgcgccagcacggccaccgtccgccgcagatgcagtactccgggcgccaccggctcgccctggtcgggcacgcacgcggccgcgacgtactcgccgaaggcctccagcgcctcgggggccagggtccgcccgccgtcccagtcgatcagcgaggccacccactgctcggcctccagcggccgcagcggcatcggggcgaccgcgccgatcgcgcagcgcacgccccggcgcgccgggtcgaggacgagccccaccgacgccacggcgcgccccggcccggtacggccggtggccttgaggaacacctgcggcgcgtgcagcagcggcacccgcacgaagccgatcagctcgccgggccgcagcatgtcccgcccggccagcaggtacgacaccgggatctcccgctgcccgaccgggccgacgatgacgagtacggcctccagcgcggccagcacgggcagtgcgtcacccgtcggcgcggcggtggcgatgttgccgccgagggtgccggcgttgcggatctgcgggggcccggcggcgcgggccgcggccgccagcgcggggatcagagcggcgaaatccggccgtcccatccgggcgtgcgtgaggcccgcaccgagcagcgcgtggccgtcctggtactgccagccgcggatctcgttgatccggcccaggcccaccagcgcggcgggccgcagcagcccggcgttgacggcggccatgaggtcggtgccgccggcgaccggcacggcggcgggcatggcggtgagcgccgccacggcctcgtcgagcgaggccggcagcgtcacggactgcgccgcctgcgggccatgcggcccctgaggtgaatccagtgcgtgcggtgcgtgcgtggtcaacccagctgccccttcccgatgtcccggttccggcgctcacgcctgttccgccgtacggtacgtgctcaccgccgggacgtggcaactctggcacatcttccggcccgcccggcgcgagggtccgccccctgcgtccggccccgggcgcggtgccccgtacgggccgtacggccctgtcgcaccgccttcggcgaccctcctccccgattgcccggttttccccgtatcaggggaaattgaggcagagttccgctcccgttccctttcggttcgggtcggcgccgccctccacgtgtcacacgttcgggggcgcgccctcgatcgggcgtccgagcacaccgggccgccgctgccgcggcaacgggccgcccggcggccggtaatcgaccccctgagcggccaaccgcgcgtagtgcgcggccatccgcccctcgaacccggcgaagtcgcgctccccgggctcgggctgccacgaccacaccacctcggcgaaggccaccagccgcgggaagacctggtagtcgacgcggtcctggttctccatcacctcggtccacacgttggcctgcgcgcccagcacccgggcggcggcctccggtgacagcttcggcggcaccggctcgaagcggtagacgtcctccagcgtgcgcacgtacccgatgggcatcggctcgtcggcgccgcccgcctgccggtggtccaggtacacctgctgctcggggcacatgaccacgtcgtgcccggcctcggcggcggcgatcccgcccgcgctgccgcgccaggaggacacggcggcgccctccgcgaggccgccctccaggatctcgtcccagccgatcagccgccgcccgcgcgccgtgagccagccgtcgaagtgccggacgaaccaggactgcagcccgtcctccccgtccacgcccagctcgcggatgcgctcctgcgcggccgcggaggccttccactgcgccttggggcattcgtccccgcccacgtgcacgaagggtgagacctcggccgggaacagctccagcacctcctcgaagaccccctcgtagaaccgcagcaccgcctcggtgggcgcgagcacgttctcggtgatcccccagtcgtcccacacgccgagcgccgcggtgtcgacgacgtcggtgttgcccagctccgggtacgcggcgatcgcggcctgcgaatgccccggcacgtcgatctccgggaccacccggacgtgccgctcggcggcgtacgcgacgatctcgcggatgtcgtcctgggtgtagaagccgccgtgcggggtctcgttccacagcggcgaggcccggtggccccaccggctgcgcgggcgccacccgccgacctcggtcagccgcgggtggcgcttgatctcgatccgccagccctggtcgtcggtcaggtgcaggtgcagcacgttgagcttgtgcgcggcgagcaggtcgatgtagcgcagcacgccgtccttgggcatgaagtgccgggccacgtccagcatcatcccgcgccagccgaaccgcgggccgtccacgaccgaggcgtacggcaggctccacgtgcggccgggcagcggcgccctgcggtacgcgtcgggtccgagcagctgacgcagcgtctgggtgccccagaacagtccggccggcgaggcgcccgtcagctccgccccgtccgggccgatgtcgatgcggtacgactccggcccgcggtcccacgcgccgtccgggtcgaggcgcagccgcagctcggcggtgacgccggccgcggcggcgggcagctcccagccggtggcggcccccagctcgcgccgcagccagcgcgctgccgtgccggttcccggaccggcgtccaggaccggctgcggcccgaacgggaagcggcgcccggcctcgtcgggaagtgcgatccggggtgcggggatcaggtccatgcgtgagcccttcacgactgcgtgcgcctgttgcgtcctgcgcaacgctcgttccgcagggcgctcgtcgcgcagaccctaacgcgccgtgcgggcacggcaaagacccccggacgcgcggtggcgcgccgggggtctcggtcccgcggaagaaggaggggccggaggccggactactggtccttgccgcccttgtccttgtccccgccggggcccatggactcgtagatctccttgcacatggggcagaccgggtacttcttcgggtcccggcccggtacccagaccttgccgcagagcgcgacgacgggggtcccgtcgagcgcgctcgccatgatcttgtccttctggacgtagtgggcgaagcgctcgtggtcgccgtcaccgtgcgacacctgcggcgtcggctctacgagggtccccgtgccagtcccgcgctcgggctcaagagtgctcatggaacccagggtacttaaccccgcgcccgtcagttgagcgacgggtcgtccggataggtggcgaccatcgcgagctcgctccgctggcggcgcagcaccgcccgccacagccgctccgggtccgggaaggacacgtccccgggctccgactccaccacgtaccaggcgccctcgccgagctccgtctccagctggcccgggccccagccggagtagcccgcgaagatccgcaggccgcccagggccgccgccagcagctccggcggcatctccaggtcgaccagcccgatcgccccgtgcacgcggcgccagccgagcggaccctcctcgcccgggatcaccgccaggcccagggccgagtccatggccaccggcccgccctggaagaccaccccgggggagccggccaggggcgcccagggcagcaggacgtcgccgacgcccacgggggtcggcctgttcaggaccacgccgagggagccctgctcgtcgtggtcgagcagcagcacgaccgcgcggtcgaagttcgggtccgcgagggcgggggtggccacgagcagccgccctgtgagggaggacacctcggtcatgccgccatgatcccgcacatcggccgattccggggagcgggcgggaagatcggatcgatcgcagctcagggcgcacggcagcagcgaggagcgcgcacggacggagtaggcggaacgcaacactccgccatgtggtggatacggagggtgttgtgccgaattcatgacagtcctacggccacgtcggccttacgaacaagggggtgatggcccttacccttttccctggccccctgcccacccctctccggaacgcgagattcatgaccggcatcagtgacgatgtactgcttgtccacggcggtaccccgctcgagggcgagatccgtgtccgtggtgcgaagaacctcgtgcccaaggccatggtcgccgctctgctcggcagcgaacccagccggctgcgcaacgttcccgacatccgtgacgtgcgcgtcgtccgcgggctgctccagctgcacggggtgacggtccgtcccggcgaggagccgggcgagctcgtgctcgaccccacccacgtcgagagcgcgaacgtcgccgacatcgacgcccacgcgggctcctcgcgcatcccgatcctgttctgcggccccctgctgcaccggctcggccacgccttcatcccgggcctgggcggctgcgacatcggcggccggccgatcgacttccacttcgacgtgctccgccagttcggcgcgaccatcgagaagcgcgagggcggccagtacctggaagccccgcagcgcctgcgcggctgcaagatccgcctcccctacccgtcggtcggctcgaccgagcaggtgctgctgacggccgtcctggccgagggcgtcaccgagctcagcaacgccgcggtggagccggagatcgaggacctcatctgcgtcctgcagaagatgggcgcgatcatctccgtcgacaccgaccggacgatccggatcacgggcgtcgaccgcctcggcggttacaaccacaaggccctcccggaccgcctggaagccgcctcctgggcttccgcggcgctcgccaccggcggcaacatctacgtgcgcggtgcccagcagcgctcgatgatgaccttcctgaacaccttccgccgcgtcggcggggcgttcgagatcgacgacgacggcatccgcttctggcacccgggcggcccgctgaaggccatcgcgctggagacggacgtgcaccccggcttccagaccgactggcagcagccgctcgtcgtggccctgacgcaggcctccggcctgtcgatcgtccacgagacggtctacgagtcccggctcggcttcacctcggcgctcaaccagatgggtgctcacatccagctgtaccgcgagtgcctgggcggcagcgcctgccgcttcggccagcgcaacttcctgcactcggcggtcgtctccggccccaccaagctgcagggcgccgacctggtcatccccgacctgcgcggcggattctcgtacctgatcgcggccctggccgccgagggcacctcgcgggtccacggcatcgacctgatcaaccgcggctacgagaacttcatggagaagctcgtggaactcggcgcgaaggtcgagctgccgggcggcgagctcgtctgagccccgccgcgcgcacgtcgcggcggctcgcgtacgcggaagccccccggtcccccacagggccggggggcttccgcgtaccccgggcccgccgcggccgggcccgaaggcccgtacggcggccgcacggatgccgtgaggcccgtacggagccgccggcggtccggcgggacatgccgcgggcatacgtgggccccgccaggcccctgacgggccctcacagggcctgccaggcccgcggggcggctcgggtgcggccccggcccgtccggccccggacagaccgaagggcggccaccccgcccgggggtgaccgcccatcgtcgttctgcgtactactgccgttccaaaggcctgcgcggccttcggcgccggggcaggacttacttgcccttggcggcttccttgagcttggagcccgcggagaccttcacgctgtagccggccgggatctggatggggtcgccggtctgcgggttgcgcgcggtgcgagcggcacggtgggtgcgctcgaaggtcaggaagccggggatggtgaccttctcgtcgcccttggcgacaatctcgccgacggtctcggcgagcgcggccagaacggcgtcggcgtccttgcgggtcacctcggcgcgctcggacagagcggccaccagctcactgcggttcatgttgtactcccgtgttcaacttgccttagaggcgtgagatcgaagccgatgctgccagggccctaggacagtccccggacccgggtctgaacgtcagaccctctcgcccggttacgcatcctgcccccaccagcggcgggaaagccaatccggcacccgtcggggtcacacgaaaagcgccacagtcacgccgcggtgacgctccgtccacgccgtcgctcacacgccgctgcggaccgcggacctcgcgggcatccccgcaaccctagaggcggcccgtcgggcccgcatcccgcgacgcgccgggatcggagcgccgtgagggccgtcacagcggggctcaggcccccgcggcggccttgcggacggcgcccgcgaccgcgcccgcgaccttgtcgttgaacaccgacgggatgatgtagttcgcgttcagctcgtcctcgcccacgacgtccgccagcgcgctcgcggcggccagcatcatctccgtgttcacggtgcgggactgagcgtccagcagaccgcggaagacacccgggaagaccagcacgttgttgatctggttcgggaagtcggagcgcccggtggccacgacggcggcggtctggcgggcgacggccgggtcgacctccgggtccgggttcgcgagcgcgaacacgatcgcgccttccgccatcgcggcgacgtcctcgccggagagcacgttcggggccgagacgccgatgaacacgtcggcgccgaccacggcttccttcagcgtgcccgtgtagccctcggggttggtgttgtcggcgatccagcgcagcggggagtccgcggccgcgtcgaccaggtcggggcggtccgcgtgcacgacgccgtggatgtcggcgctcaccgcgttcttgacgcccgcggcgaggagcagcttgaggatggccgtaccggccgcgccggcacccgacatgacgaccttgacgtcgccaactgccttgcccaccacgcgcagtgcgttggtgagcgccgcgagcacgacgatcgcggtgccgtgctggtcgtcgtggaagacggggatgtcgagggcctcgcgcagccgggcctcgatctcgaagcagcgcggcgcggagatgtcctccaggttgatgcccgcgaagccgggggcgatggccttcacggcggccacgatctcgtcggggtcctgggtgtccaggcagatcggccaggcgtcgatgtcggcgaagcgcttgaagagggccgccttgccctccatgaccggcatggcggccatcgggccgatgttgcccaggcccagcacggcggagccgtccgtcacgactgcgacggtgttgcgcttgatggtgaggcggcgcgcgtcctcggggttctcggcgatcgccatgcacacgcgggccacgcccggggtgtagatcatggagaggtcgtcacggttgcggatggggtgcttggacgccatctcgatcttgccgccgaggtgcatcaggaaggtgcggtcggagaccttgccgaggctgacgccctcgatgccgcgcagcttctcgacgatctcgtccgcgtgcgcggtggaggtcgcggcgatggtcacgtcgatccggagcttctcgtggccggatgcggtcacgtcgaggccggtgaccgatccgccggaggactccacggcggtggtgagctgggagaccgcggttccgctcgcgggcacttccagacggaccgtcatcgaatacgagacgctgggcgccgatgccatggccgtgttcctcttctgtccctggttcgctgtaacacacagagccccgctgcacagcaggtgcggcaggacctgttgtccgatcgtcccacctaccagccagtacaaggtaaccagctacaaaattcggaaagactcttccaccatacgagataccaggagcgttcggaatggtggggtcatacgaaacaggtccgcgccccccactggtgggggacgcggacctggtgattcatacgctgacgacaccgacccgccatgctcgcctcgcggcaagtggtcgctctgagcgacgaaggttgggcccgggggcttggatcgagtcggtgccgtacccaggctaacaaaggatcgccgaatgtgatccccctgctcgcgtacgtatcggagcaccacgctcccggccgccgcccatccggacgtacccggccccgggcggccggtccaccggcagcccctacggcaggagcagctccgccaccccgtccgcgtccggcttgtcccgctcggccgagacgaccgtcagctgctgcgtcgcacgcgtcagcgccacgtacagcacccgcagacccgccggggactcgtccgcgatctccgccggggagacgaccaccgtggcgtcgtactccaggcccttggcctccaggctgcccagcgccaccgcccgctcgccgaggtccgcgagccaccccgcggcctccgcgcgccggtccatcgccacgaccacgccgaccgtgccgtccacctgctccagcagcagccgggtctcctcccggaccgcggcggcgagatcgccgccggcggccgtgaaacggggctccaggcccgtggagcgcaccgccgacggcggctccatgccgggcatcgccagacgcagcacgcgggaggccacctcggcgacctcggccgggttgcggtagttcaccgtgagcgtgaagcgccgccgcggccgggagcccagggcctcgtcccgggccgcggccgcctcctccgggtccgtccaggaggactgcgccgggtcgccgaccaccgtccaggtgccgtgccggccccggcggcccaccatccgccactgcatgggggtcaggtcctgggcctcgtcgacgatgacgtgcgcgtactcggtgcgctccgccgcgagccgctcggcccgctcccactgggtctcctcgcgggtcggcatcagctcctccagcccgctgagctggtcgagcgggtccatctcccgtctgcgcttcggccgcgccggggcgccgagcagctgctggagctcgtcgaggagcgccacgtcgtgcaccgacaggggacccttgccgtcggggcccacccggcgcagcgagcgggccagctggcggctctcgcgcgggttgaggtcccggcgcgaccagcggccgaggtggcgctcgtcggcgagcgcggcgagcaccgtgcgcggggtcagctcgggccaccaggcgttcaggaagccgatgaaggcgtcctcggtggagatgtcctcgtcgaaggcggagcgcagttcggcggccagctccgggtcgctgtgccggccggcgccgccggacttcgcgtagagggcgtcgagcagcagcttgcgggcgcgcgggcgcagcaggttgaccggggcggtgccgccgagcacgttctgccggatccggttcagctcgtcggcctccagctcctggcggcggccgaaggccaccacgcgcagccggtcgggggcgccgccgagctccagcgcgccgcgtacggccttgcggagcaccttgagcatccgggaggagcccttgatgcgggccacggccggggagtcgtaggtggtggcctcggcgccgtcgacgagcgagcccagcgcccggatggccacctggccctcctcgccgagcgagggcagcacgccctcggtgtacgcgacgagcagcggggtcggcgagacgatcaggatgccgccggagtagcggcgccggtcctggtagagcaggtaggcggcgcggtgcagggcgacggcggtctttccggtaccggggccgcccgcgacctcggcgacggaggcggcgggggcccggatgaccaggtcctgctcggcctggatcgaggagacgatgtcgcgcatggagtgcgtgcgggcccggccgagggcggccatcagcgcgccgtcgccgatggcgggcagttcccggccgtcgaggaaggcggtgacctcggggcgcatcaggtcgtcctcgacgcccagcaccttgcggcccttggagcggatgacgcggcggcgcacgacccggccgggctccttgggcgtggagcggtagaacggcgcggcggccggcgcgcgccagtcgatgacgagcggcgcgtagtcggagtccaggactccgatgcggccgatgtgcagtgtctcggcgatgtcggcggtgaggtcctcgcggatcgcgtcgtcggcgggctcgacggaggtgtacgcgccgtcggcgccgcgctccccgtccttgccgagcaccaggtcgatgcggccgaagaggaagtcctcgaactcgttgttcagccggttcaggtggataccggcccggaagacctgcgcgtcgcgctcggcgagcgcgccgggcgtacccacctggccgcgcttggcggcgtcgttcatgaggaactcggcctcgtggatcttctcctcaaggcgtcggtacacctggtcgagatgcgtctgctcgaccgcgatctcccgatcgcggacggaatccgccgtgctgtcgacagcggcattctgcgcggccaccaaggcccccttctgacgtgcatgggcgaccgtcaaccgtacgcgaaccggccccctgtccgcacgcccgttccggaaccggtctcgcagggtggtacgtctcccaccggcacccctaccccgccccggccgcgagggcccggcggcggtgccgggctacgcgctcccggttcccgcagcgctcgctggagcaccagcggcgccggtggccgcgggaggtgtccaggtagacgcgggtgcagccgtcacccgcgcaggcccgcagcagggcccggtcaccgggatcggtcagcagctccacggtgtcccgggcgacggccgcgagcagtgcgccgcactccacgccgccgcacaactcccgtacgaggtgtccttcctggtcccgtacggcgcacagccccgggggtggtccggcggccagcgcgttgacccgggcgagggcgttctcgtcggggtcggtgccgacgagctccgcccgtacgagcgtttccacgtcggcgcgcagggagcggaaggccgccgcccagtcgggcccgacccgggcgagcggtgtccggtcgggtaccaggccggcgccggcgagccacagccgcagctcgtcaccgtccgggatgccctcgtggggggtgaaggtggccaccaggtccagacagacccgcccggtatcgaaccgcatgccgtcagcctcccgtcgtgggggtgccgtaccagattgccgcccggcgggtcacagcggaagcccccgaaccggtgggtccaccgtcccgctcgcgcgaagccccacccagtcctcgccggcgaatccggctacacgatccggccccggcggcagcggaacggctagccggccggaggccggtcgtggaggaggcgctggaagaggcggtggtcgcgccaggcgccgtcgatgtggaggtagcgcggcgcgaggccgaacggttcgaagcccgccttggccagcacccgctgcgacgccaggttgtcgaccagcgtgctcgcctccacccggtgcaggcccagctcgtcgcgggctacccggcagacctccgccacggccgccgtggccaggcccttgccgtgccaggcccggtcgacccagtacccgatgccgccgctgcacagcggcccgtacgcgatcgagccgagattgatcgcgccgacgggcgccccggtggccgtctcgacgaacacgtacggcacgagccgccccgcgtcccgttccacgaggacgccctcgatccgttcccgctggccgtcctccgtgtagaaggcgtccggccggaccggctcgaagggcgccatgaacgcccggttccgggcgaacgcctcggccagcccggcggcgtcgccgagctcgacgcctctcatctccaccccgtcaatgatcatcccggcacgctagccgaggacacccctggccgtcaccgcgtccgccgggacctccccgtacttggcctcgccgcccgcgtccagcgagagccggtatccccgcttgaccaccgtctggatcaggttcggggccccgagggccacccggaggcgggccatcgccgtctccacggcgtgctcgtcccgccccgcgcccggcagcgcccgcagcagttccgcgcggggcaccacccagcccggccgccgcgccagcgcccgcagcagggccatcccggcgggcggtacgggccgcagcgcgtcgtccaccaggaccgcgtggccccggatctccacccggtgcccggccaccggcagcacccgcgcccgggccggcagctccttgcagagcaactgcaccagcggtcccagccggaaccgttccggctgcaccgtgtccaccccgtgcgcctgcagcggcagcgcggtcaccggcccgacgcacgcggccagcagcctgccgcgcagcgcgtccaggacggcctcccgcagcccccgttcctcggcccgcgacagcagcgaggccgccgccggcgccgaggtgaagctgacggcgtccaccgcgccgccgacgatcgcgtccagcagccggtccagcggcgcgatgtcctccggcgccatccaccggtacaccgggaccaccaccacctcggccccgccggcccgcagcgcctcgacgaagccgggcaggggctccccgtgcagctggagcgcgatccgccggccgtcgaccccgtccgccagcagccgctgcagtacctcggcgagcgattcggagtccggggaccaggtctccacgagcccggcggcccggatggcgcccttcaccttcggcccgcgcgccaggagttcggcggcccgcagccgttccagcagctgctcgccgactccccacccgtcggccgcctcgatccagccccggaagccgatggcggtggtggccacgaccacgtccggtgcgcagccgatcagttccttcgtcgcggccagcagctcgctgtcgtcggcgagcggcacgatccgcagggcgggcgcgtgcaggaccgccgccccgcggcggcgcagcagcgcgatcagttcgtccgcgcgccgggcggccgtgaccccgacggtgaagcccgcgagcgggccggcgttcgtgtccatcgtgacctgcctagagacgcatggggggcggtacgggtgaaccgagtctgcccacacgtcgtgtcggactcggttcacccgtatttcgccccggttacaccgacgtgagctgcggtttcgtctcgacgccgactgtgtggatcaccggggccaccgggcggcgaaggtataccgcccaggtgaccgcgcagcacagggcgtagaagccgaggaaggtgacgaaggccgtcgttccggagccggaggtgcggaacgcctcccggaagacgaggttgatgccgagtccgccgagcgcgccgaccgccccgatgagtcccatggaggcgccggagagccgccgtccgtacgcggccgcgctctcgccgctcatgccgcgcgccagtgccttcgcctggaagatgcccgggatcatcttgtacgtcgatccgttgccgaggccgctcagcacgaacagggccacgaacccgacgaggaagaccggcagcgaggaccgctgcgaggcgaacaccaccaccgaagtggccgccgccatcgccacgaacgtccccagcgtgatgcgcgccccgccgaaccggtcggccagggccccgcccaccggccggatcagcgatccgagcagcggtcccatgaaggtcagcgaggcggcctggagcggggtgcggccgaactgggtctggagcacgaggccgaaggcgaagctgtatccgatgaaggacccgaacgtgccgacgtagaggaaggccatgatccaggtgtgcgcgtcccggagggcctcgcggaccgcgccggtgtcgttgcgcacgggcgccaggttgtccatccgtacggccgccaggacggccgcggtcacgatcagcgggatgtaggcggccagcaggtaccgggggtgtgcggccccggcggtcgcgatgaccaggagcccggccagctgcaccacgggtacgccgatgttgccgccgccggcgttcaggccgagcgcccagcccttcttgcggagcgggaagaaggcgttgatgttggtcatggaggaggcgaagttgcctcctccgacgccggtgagggcggcgacgaccaggaaggtcccgtaggaggtcccgggctccatcacgacgatcgcggcgaccgtcggcacgagcagcagcacggcgctgaagacggtccagttccggccgccgaagcgggcgacggcgaaggtgtacggcacccgtacgaggccgcccacgcaggtcgcggtcgcgatcaggaagaacttcccggcggggtcgatcccgtacgcggggcccatgaagaggaccatcacggaccagagcgaccagatggagaacccgatgtgttcggagaacacggagtagacgaggttgcggcgggcggtccgctcgccggtctccttccagaaggtctcgtcctcggggtcccaccgctcgatccagcggccccccttgcgcggtgcggtcgtaccggtcatcacacgcctccacagctctctcgcgtccgtggaacgaccgtaggaacggcgcgtttccgccctggtccccgccggatgaccgccgggaaaccttgctctcacccgccgccgggggcgcctgtgagcgcggccgggcgccagctcgccgggggcacgtcgagccagccgcgtgcggcaccgaggtcggccaccgcccggtgcagggcttcgagcccggggtggctgaagcccttccgccacaccatggacagcggggacagcggtacggggtcggccagcggccgtttcacggacccgggcatgtcgacgaagtcgacggtcaccagcaccggatggccggtcttggccatgacccggcggaactcgtccttgccgatggccaccggtgcgggcggcgccatccggatgccccgcccggcgaagagttcgcgggcgagtccggtccactccagggtgcgcgggttcccggcgcccgcgtacacggtctccccggcgagcgcgtccagcggtacgggcgacagcccggccagcgggtgcccctcgggcagcagcacggcgagcggctcgtaccggacgggccggtgcgcgatgcgcgagcgccacaccgggtccagcccgtcggcgtacccgaaggagacgtcgaggcgtccggcgacgacctcggcggcggcgtgggtcagcccgctctcccagcgggccatcagctcgcagtccggggccagctcccgggcccgctccagcacggtgcgcgcggtgctcggcccgtcggtgttcaggtcgacgaggagcggccggggcgcggcgaaggcggcggcgaccgcctcgtgcgcggccagcacccgccgggcgagcggcagcagccgctccccgtcgggggtgggctcgacggcacgggtggtacggacgaacagcgtggtgccgagggcctcttcgagtcgccgtacgtcccggctcagcgcctgctgggcgacgtacagccgggcggcggcccgggtgaagtgcagctcctcggccacggcgacgaacccgcgcagcagccggggatccacatcacggggcatcacccccggagactaacaacagatcggcgtgaatgacctccgaacaggtgttggacggttcgcccggtccgggccgagggtggtggtcatgcccctcatgaccgtcaccggcaccaccctcgtcctggccgccccgcccgcccccgcccgcgctccccgggcccctcgcggcccgctggccccctaccggcgcctgttcgcacggcccggcacccgcggcttcaccgccgggaacctcatcgcccgtctccccatgggcatgttcggggtcagcgcggtcatgatgatcgccgggcagcgcggctcgtacgccctcgccggcgcggtcacggcgaccggtctggccgccaccgcgctggtggcgccgtggaccgcccggctggtcgaccggcacggccaggccagggtcgccgtcccggccaccctgatcgcggtcctcggctcgctgtccctggtcgtctgcgtccgtaccggcgcccccgcctggaccctcttcgcctcgtacgccgcgaccgcgacgacccccaacatcggcgggatgtcccgcgcccgctggacgcacctgctgggcgactccccggccgcgcaccacaccgcgatgtccttcgagcaggccgccgacgagctctgctacatgctcggcccggtcctggcggccttcctgtgctcgatcgtcctccccgaggccggcacgctcaccgcggccgccctgctgctcaccggcatgctggtgttcacctcctgccgcgccacccagcccccggtgacggccggtccccggcgcggctcgccgctgcgggcgctgagcccgctgctgcccctcttcttcgccacgggagtggtcttcggctcgatggagatcgcctcgatcgcccacctcggcgccctgggcctgggcgccgcctccggcccggtgctggccctccaggcggcgggatcctgtgcggccggcctgctctacggcacgatgcgcccgctcggcctgcgcacctgcctggccgccatggccggcgcgatgacgctgccctggctcgcggcggccacgggctccctgctccccctggccttcgccctgctgctggcgggcatggccacggccccgacgatggtgacggcgatgtcccgcgtccacgcgctcaccccggagggccgcctcaacgagggcatgaccctcgcggtcaccgccatcttcgcgggcatctccctgggcgcggccacggccggcaccctggtcgaccacctgggcccgtcggcgtcctacgccctcccggcggcagcggccctcgcggctctcgcgaccgtcacgcgtaccaggtgatacggcagccggcatgacaaaggccccgcagccttgaggccgcggggcctgtgcccacatgggatgagtggagatggcgggaatcgaacccgcgtccaacggtgcagaagcagggcttctccgagcgcagtccgctgcgcttttctcggccccggagatcacacggacaagtctccgacgggctcagtcactgtttgatttccctccaacccccgtgaccggggctagaggtttagatccctcattgacgccaggatccggaccgggaccacttccgggctgacgctcctcacagaggcttcagctcactgttattaggcagcgagggtgaagcgggagttatcgctcttggagttggcgattattgtttgcgacatgtggttagcgagatcattgccgcttcctcggctcgcttcccctgcatcgacatccgctgtcgaaaccgatcatccccatgtttttttaacaaagtgctccaccccggggggcggtgctgacgccatggtacgcgaagtggaccaccgcgtgccaggtgattaaaccgtgccgcgctgcttgcgacggatggccgagatcgtccggttcgtctcgcgggtgtcctgcttctcccgcatggtctgccgcttgtcgtactccttcttgcccttcgccagcgcgatctcgaccttcgcgcggccgtccttgaagtacagcgagaggggcacgatcgtgtgacccgcctcgtccgccttgcgctccagcttgtcgatctcctcgcggtgcatgaggagcttgcgcttgcgccgggcgctgtggttggtccaggtgccctggctgtactccggcacgtgcacgttgtagagccaggcctccccgctctccaccgacacgaagccgtccaccagcgaggcccggccctggcgcatggacttgacctcggtgcccgtgagcacgagaccgcactcgtaggtgtcgaggatcgcgtagtcgtgccgcgccttcttgttctgggcgatcagcttgcgccctttttccttagccatagtgcggtcattttcgcactacggacccaccccgaggccacccaataccgtgacggcccgctcctcgaccgcctcgcccgccgccacgtccggggtgatgccgtcgccgtccaggctccggcccgccggtgtgcggtacgtgcccaccgtcagctcggccaccgagccgtccgggagttcggtcggcatctgcaccgagcccttgccgaaggtccggctgcccaccgccaccgcccggccccggtcctgcaaggcgcccgtcaccagttcggccgcgctcatcgtgccgccgtcgaccagtgccaccagcggccgggtggtgtccccgcccttggccgcgtacaggacccgctggtcgccccgtacgtcgtaggtggccacgagcccgccgtcgaggaacgcggaggcggcggtgaccgcctcggtgaccaggccgcccggattgccgcgcaggtcgagcacgaccccctcgccggtcggggccgcgcggacggcggccttgacgcgctcgccggaaccacgggtgaaggaggcgaccttgatgaccgtgaccccgtccgggcgctgccgtacggtcaccggctcggtacgcagctgctcgcggcggacggtctcggtgaggtcggcgccgtcccggctcaggttcagtacgacgggggtgccggcgtcgccgcgcagcagggcgaccacgtcggtcacggcgaggccggtcacggcgtgcccgtcgacgctcagcagccggtcccctgcgcgcagtccgacccgggccgcggggctgccgggctggacccggtcgaccttgatgacgccgtcgggggcccgcccggcccacactccgacgcccgtccagcggccgtcgaggccctcggcgaaggcggcgtactcaccctggtcgtagacggtgccccagcggtcgccgctgcggctgacgacctcctgggccgccttcttcccggacttcccctcggcgacggcctcggcgacggcgcgggcgaccgcctcgcggtcggcggtgcccgactcgtgcggggcctcgggcgcgggggctcccgacagcgccgcggcggccgcggcgccctcctcgcggtcccagcagccggtgtacgcaccgacgccgacggcggtgaggaaggccatcgtcagaacggccccgcgacgcaggtcgcggggccggagacacaaggcgggaatactcggcaagcccagcatggcgccgagtctaggacaagccccgcggcggtacgggtggttggccgtaccgctcacggggcgcttgtcacaccttcaggtacttgcgcagggcgatgaaggcggccatggagggcatcaggaggccgatgaagagcacgtacgggagcttggccagcaccgatccccagcccatgaagtcgatgagctggatcttgtcccgcaggccgacgccgtggtcgatcacgaagtactggccggaggccagcatgccgcaggcgaagagcgcaccgatgaggccggcgacggccgcctccatgatgaacgggacctggatgtagaagctggaggcacccaccagccgcatgatccccgtctcacgcctccggctgaaggcggagacgcgcacggtgttgacgatcagcagcagcgccacgatcagcatgatcagcatgatgccgagcgccgccatgttgaggtagttgaggatccggaagagatcgtcgatggcctggcgctggtcgtcgacggtgtggatgccgtcacggccgacgaaggcggaggtgacgaccttgtacttctccgggtccttcagcttgacccggaaggactcctgcatctggtccggggtgatggaggaggcgagtgccgtgttgccgaaccgctcctggtagtgcttgtacgcctcgtccgccgactcgtaggcgacggacttcaccagggacatctgcttgagctcggactcgatctgcttcttctgctcctcggtcaccgcacccttggcgcaggtggtgacgcccgtggagaccgccgccgagccgtcggccttcttggcggcggcctcgctcgcctccacggcgtcctgcttgttgcagaggtagatcgagacgttggccttgtcgtaccagaagcccttcatcttgctcacctgctcgctcatgagcatggagccgccgaacagggccagggagagacccacggagatgatgaccgcgaaggtcatggtgagattgcgccggagaccgacgccgatctccgacatgacgaactgggcgcgcattgcgtctcagggacctttcagtgctggtagccgtagacgccgcgcgactggtcgcgcacgagtcggccctgttcgagttcgatgacgcgcttgcgcatctggtcgacgatctgctggtcgtgggtggccatgatcaccgtggtgccggtccggttgatccggtccagcagcttcatgatcccgaccgaggtctgcgggtcgaggttgccggtgggctcgtccgcgatcagcagggcggggcggttgacgaaggcgcgggcgatggccacgcgctgctgctcaccgccggagagctcgcccggcatccgctcctccttcccgcccagacccacgagttcgaggacctgcgggacggccttgcggatctcgccccgcggcttgccgatgacctcctgcgcgaaggccacgttctcggccaccgtcttgttgggcagcaggcggaagtcctggaagacggtccccagctggcgccgcatctgcggaaccttccagttggagagcttggcgaggtccttgcccaggacgtgcacctggccgtggctcgcccgctcctcgcgcaggatgagccgcaggaaggtggacttgccggagccggaggagccgaccaggaagacgaactcgcccttcgcgatgtcgagggagacttccctcagtgcgggacggctctgcttcgggtaggacttggagacactgtcgaatcggatcacgggtgcaccacggtcgccgggagtaggtgtgcgtgaccatacgcgaacgggcgcgaggtgtggacccggcctccggacttgcccgatttatcccggggtccgggcgcccgggatcgtgattgcccggacgggccgcgccgaatgtcggcgaagctggcacagtggtagggggaacggtctggttccccgtgccgttataggcagcagaagaccgaggggacgagaggaggagcgcatgacatatgaccggctcgtgtgcgcgaactgcgccgcacccgtcagccagggccgctgcccggtgtgccgggcgaaccgggagcgcctccagcaggagggccccttctccggcctgaatcccgtgacgctcatcgtgctcatggtgatcctcgtgacagctctggcactggtggcccagcacaccgcctagaggccttgagggtgtcctgaccgcccggccgtggggctagcggtgggcccgcgccacgtaccgatcacacgacgcggcaacgcgagaagggcccggacaccaggtgtccgggcccttccgcgtgtccacgtgccgtgggcgtcccgctcggttacgcggtctgctcctgctgcttgcgccagcggattccggcctccaggaagccgtcgatctcgccgtcgagcaccgcctgcgggttgccgacctcgaactccgtccgcaggtccttgaccatctggtacgggtgcaggacgtaggaccgcatctggttgccccaggagcttccgccgtccttgagggcgtccatcttgtccttctcctcctggcggcgccgctccagcagcttggcctggagcacgttcatcgcactggccttgttctggatctgcgagcgctcgttctggcaggagacgacgatgccggtcgggatgtgcgtgatgcgcaccgccgagtcggtggtgttgacgccctggccgccggggccggaggcgcggtagacgtcgacgcgcagctcggcctcgtcgatctcgacgtggtcgctggtctccacgaccgggagcacctcgacgcccgcgaaggaggtctggcggcggccctggttgtcgaagggcgagatgcgcacgaggcggtgggtgccctgctcgacggagagggtgccgtaggcgtacggggccttgacgacgaaggtggtcgacttgatgccggcctcttccgcgtacgaggtctcgtagatctcggtcgagtagccgtggcgctccgcccagcgcaggtacatgcgctggaggcgctcggcgaagtcggaggcgtcgacgccgccggcctcggcccggatgttgaccagggcctcgcgctcggcgtactcgccggagagcagggtccggacctccatctcgtccagcgccttgcggacggagacgagctcggcctcggcctcggccagggtgtccgcgtcgtccatctcctgggcgaggtcgaagaggaccgcgaggtcgtcgatgcgcccccgcagggtctctgtcttgcggacctccgcctggaggtgcgaaagcttgctcgtgatcttctgagcggcctccgggtcgtcccacagggacggcgcggcggcctgctcctcaagcacggcgatatctgccctcagcttgtcgaggtccaggacggcctcgatcgaccccatggtcgaggagagggacttcagctcttcggaaacatcgacgactgccacgggtccagcgtagccggtccccggacaacgccgtccgggcaggctgaatcacccgtactgatgagggatcgtacgggcgtacgctctccgtatgaccgttctcctcgtcaagcgccgccatgtcgaccacatgcgtgtcacgacgacgagctgtccgccgccggaccgaacccaagcctgatccaccacgatccgacttggtcctgtacgcggcacccgtggcaccggcaccatccatgccggagaccatccccccgcccgcggcccccaccacctctggggaacaggaccccgtgacatccgaaacggagccgtcatgccgtccgcgcacactctcccggtcctggacctctcccaggccgacgacccggcccagcgggccgacttcctgaagaagctgcacgcagcagccagggacaccggtttcctgcacctgaccggccacggagtcaccgccgccgagagcgcccgcatcctcgacctgaccaaggccttcttcgccctcccggaagccgaccggctcgccgtcagcaatctgaactccccgcacttccgcggctacacccggatcggccacgagctgaccggcggcgcctccgactggcgggaccagctggacgtgggcgcggagcgcccggcgccggtcgtggggccggacgacccggcgttcctgtggctggagggcccgaaccagtggcccgccgccctcccggagctccgtacggtggtcctggactggcagtcccggctcgccgcggtcgcccaccgcctgctccaggagctcctcgtggcgatcggcgccccggcggacttcttcgacgaggccttcgcggaccgcccgcacctgcacaccaagctgatccgctacccgggatcggccccctccggcgccgaccagggggtcggcgcccacaaggactacgggttcctgacgctcctgctgcaggactcggtgggcggcctccaggtggtccgggacggcggctacgtggacgtaccgccgatgccgggcgccttcgtggtgaacctgggcgagctgctggagatcgcgaccgagggctacctgacggcgacggaccaccgggtggtcagcccgcccggcgcggtggagcggtactcggtgccgttcttctacaacccgcggctggacgcggtgatcgagaccgttccgggcgagtacctgcgctccgcgcccggtgtcgcgcacgacgactcgaaccctctgcacgccgagtacggccgcaacgaactgaagggctgggtccgcgcccacccggccgtggcgcggcgctggcacccggaactggccacggtgtagccgtcccgggccacagggcggagccttccgggctccgcccggacccgcgcctcaaacgccggcgaggctgaattcggccaccccgaccgcggcgccgcacccggcggctagcgcttcgccgggaccgactgcttgctgtcctgcgggggcggggcctcgtcgcccgagacggccacccacgtgcccagaccgacggccgcggccagggccagggccgacaccgacagaaccaggcggcgcttgcgggccgcctccgcacggtgccgcgccgagcccgggcggtggccgcccgcggggcgcggtacgcgggcggtgcccagcgccccgcccgccagctcgtccggccccggcacgcgcatcgaggtgtgggtgtcccggttggagtcggtcgccgagcccggcaccagcgggaccacgccccgccgccggaccgggtcggccaccggttcctccgagggctcggggtccggatccgcgtcgtccggctcgtccacgtccagcggcggcatccccgccagcagcggcagcaggtcccgcagccggaccgacagctccgaggcccgcagccgcgaggccggggccttggccagacactgcacgacgagctgccacagctcgtcggggatccccggcagcgggaccacggtctccgtcacgtgccgccgcaggaccgcgcccgggtggcccccgccgaagggggtgaatccggccagcagctcgtacaggaccgtggccagggcatatatgtccaccgcggcccgcgggggcaggccctcgacgatctcgggcgccaggtagtccggggtgccgatgatccgggtcgtcggggccgaggcccggcccgtggcggcccgccggggggagtcgatcagcttggccacgccgaagtcggtcagcagcgccgggtgcgagccgccggggccgagcggtccctgcatgtccagcaggacgttctccggcttgacgtcccggtggacgacccccgccgcgtgcgccgcggccagcgcgtcggcgacgtccgcgacgatcgccacggccgcctcgggggcgagccgccgttcgcggtcgaggcgcgtgcgcaggtccgtaccgcggacgaggtccatgacgagggcgaggtcgttgccgtccacgacgaggtcgcggacggagacgacgtgcggatgctccaggccgagcagcgcgctgcgctcctggacgaaccgtccgacgagttcctggtcggacgcgaggtcctcgcgcagcagtttgacggcgacgggcccgtcaggcccctcgcccagccacaccgtgcccgcgctgccgcgccccaggatctggtgcgcggtgtaccggctgccgatcttccgtgccacgactgctccctcagcggctggcgtacgcaccaaagctacgcggccgggtgggcattggaggccagcagggggccggattcgcggcgaccttcacttctgcgagcgaaatcgtgtcccagaagtcgacaaatccactgagtcggcgctacgagggtccgcctcagggcttgccggagcccgaggagcccgcggagtccccgatcgtgccgacccagtcgacgacgtcgttgccccaggtccagacctggtcccaccagcccttgccggtgccgatccactcctggagcggggtcagttcccagaccagccagccggcgacgaagaacaccaggatcagcaccaggcagcccttgaggcagccgaggccggggatccgcaccgggttggcgctgcgtcggcgcggctcgcgcggctcccggggggccggccgctgcggcggggcctgcgggggctgctgctggggctggcggtactggggctgctgcggctgaggctgctgctggtacggctgaggctggtgctgctgcggctggtagtgctgcggcggcggaggtgcgtactgctgctggggcggctgctgcggctggcggtactgcggctgctgaggctgctggtactgctgctgcgggggcggcgggccctgccggtactgcggcggctgctgctgcggctgcggccggtgctgcggcggcggaggcgcctgccgctgcggacggcggcgcagcgggtcctcgttcgggtcgaggtactggatctgcgtctgctcgttgcggtcccgcgcggcctgcatctgcgactgccacgggtgcggcgagtcggggcgctgcaccgggggcatcaccgaggtcgggtcggcgccggggcccgcggtgctcgacagcaccgaggtggcgtcggccgcaccgaccgggggcatgacgctggtcatggcgttcgggtcgtacgcgccggcctgcgcgcccgtcgagggcagcatctgcgtggggtcggcggcgccgggggtctcggggaccggggccggcgaggggtcgggcgcgagcagcgcgcccacgccgagcgcggcctccacctcttcggccgaggagtgcacgccgatgccggaggccaccacgcgcagtccgcgggccaggctctcggcgctgggccgctcgttcggctccttgcgcaggcagcgctcgatgaccgtccacagcggttcgggcacggtgggcggccgctgcgggtcctcgctgaggtggcggtggagcacttcgagcgcggtgccgccggcgaacggcgggcggccggtgagcagctcgtagaggaggatgccggcgccgtagatgtcgacggcggaggtctgcgggcggccctcggcggactcgggggcgacgtaggccggggtaccgacgaactcgtgggtgcgggtcaggcccggggagtcggcgaggcgggcgatgccgaagtcggtgagcatcggcttcatctggccgccgcgctcgtcgagcagcacgttggccggcttcaggtcgcggtggaccactccgtcggcgtggctggcggcgagggcgtcggcgatctgggcggtcagcaggctcgcggcgacgggcgtgaaggggccgttctcgcggaggtaccggtgcaggtccgggccgtcgatcaggtccatgaccagggccagcagatcgccctcgacgacgaggtcgcgggtgcgcacgatgttggggtgggtcaggcgcagcaggaccgagcgctcccgcaggaagcgcatgacgatgtcgggatcctgggccagctcctccttgaggaccttgatggccacggtctccccgggctgtcccgtgacggccgcctccgcgccggcggcctccctctggcgggcacgccagacagtgcccgtggcgccgcgcccgagcggctcctcgagcaggtacttgctgccgactggccgcacgtctcgcgctcccctgctgtcgtctgctgtggtcgatctgctgattggttttccggcccactctagggggtgtcccccgggaagacgccggtccccggaggttggttgccgcacatatgtgcggagggtgatgtttgcggggtatgccggaggcgattttccccgtctttaccggccttggtgtccggatccgaccggggtccgacccaggtccccgcacatcaagatcatttgttgccgggtgccgggcgtgttgtccgtgacaggtgcgaggatgcacatgtacggacggcacgggacgggagccccgccttccgggcagacctgaccggacgacgcgtccgtgccgggtggggggcgaccggggcggtcatgtcacgggatccccctgccgggcgcacacaccgcgcaccgcgcagaagggaccgctgacggcgatgcagatccggctgaccgtccttgggtcgcgcagcggccaccacaccgcgaccgcccccgcgagctgtgacgtgctcgtcaccgcacccgtcggcaccgcgctggccgcggtcgcctccgggctcgcggccaccgtcggcgggcccgacaccgggggcacggtcgtgctgtacgcgggctccgagcgcctcgacctccagcggcgggtgctcggcgaaccgccgctcgtggacggcgcggtcctggcgctgcacgggccggtaccggacgtcctgccggaggacggcctcggcgcggcccagctgcacgtcgtcgccggacccgacgcgggcggggtgcacctgctgcacagcgggcagatccgggtgggccgctccgccgacgccgacgtccccctcgacgaccccgacgtatcccggctgcactgcgcggtgacggtgatacccgacgggcgggtcgcggtggccgacctgaactcgacgaacggcaccaccctggacggctcccccgtgggggcccagcccgtccccctgccgccgggggcgctgctgcgggtcggcgagtccaccctgcggctggccgccgcgggcgctcccgcgctttcggtgaccccggacctgcagggccatctctcggtctccgcccggcccgccgccgccgcgcttcccggcccgctccccggggcggatccggccgcgcccgggccggtgccggacgcacccgggctccccgggctccccgacgcgcccggtgcccccggtgcagcccccggggccggtccgcagggcgaggcgccgagccccggcaccggccccgactcaggctccggcaccagccccggctccggctccggccggcggaagggcctcggcgcctgggcccgtaagtgggtgcgcggcgaggaacccgccgaggccccgccggaaccggtgctcgccgcccccgaccccgacgatcccgccgcgctgctgctggccgcgatgggccccaccgagcgcctgtggtcccgtacgcccggacagcccgccgcactggacgtggggctcggcgccgggagccgggtgtccctgcccgccgtcggcgccctcgggctcgccgggccgcggacccggctggccggggccgcccgctgggtggtcgcgcagctggcggcactgcacgcgccgggcgggctggagatcgtgctcgtctccgccgaccgggcgcgcggcctcgccgaccggcggcgcgactggggctggctcggctggctgccccacgtccggcccgcgcacggccaggactgccggctgctcctcgcgtacgaccgcgaccaggccgtcgcccgcacgggtgaactgacccggcgcctcgacgaggggccgctgggcgtgcactgggccgccgccgatgcgagccaggtgcgccgggccgccgccgtctacgaaggcccgtacacgctcctcgtcctcgacggcgatccgggggccggcccgctgcgcgacgtcaccggccggctcgcctcgcacggcccggccgtcggcatccacgtgctcgtgctcgccgaggccccggccgccacccccgcctcgccggtcgccgagacatacgaggccgcctgcgcgagctcccccgccttccgggactgcggcgcggtcgcgctgctcagcggggatgtggccacggccgtgcgcaccttcacgatcagcggcggcaggccggtcccggccgggggcaccaccagcgccgacgccgtctccgtcgcctgggccgagcgcttcgcccgcgccctggcaccgttgcgcaccgccgagggcggctccgccgagccgtaccggccgaccgcggccgccctgcccgccaccgcacggctgctggacgagctggggctggcccgggccaccccggcctccctgatggcccgttgggccgccgccaccgaccaggggcagggcgtgggcggcctcgccgagatcgtgctgggcagcggacgccgcgggcccgtcggcaccgagctcgtccacgacggcccgcacctgctcatcgaggggcccgccgggagcgggcggaccgagctgctgcgctcggtggccgcgtcgctgtccgcggccgcgcggccggaccggctcggactgctcctcctcgacggggccggcggcgagcgcggcgacgggctgcggccctgcaccgagctcccgcacgtctgcgcccatctggtggcctccgatccgctgcgcatgcgggagttcgcgcaggcgctcggcgcggagctcaagcgccgctccgagctgctggaggagttgtccttcgccgagtggcacgcgcagcgcgaggtgtccgaccggatggtctcgccgcgccggcccgccccgggcgagcagcgcggcgacctcgacccccagcggaccggcacgctgcggctgcgggccgcgaccacccgtacggatcctcccgggcccagcccgctgccgcgcctggtggtgctcgtggacgacctcgacgcgctggtcgcgccggggctgggcagtacgggccgccccgccgccggctcggtggtccgggccctggaggcggtggcccgcgagggcgcccggctcggcgtgcacctggtggccgccagcgcccacccggaccgtacggcggagaccgggccggcccggctggccaccctgcgcgtggagctcgacgcccccgaccagccgggcccgggccggggcatgctccgcttcggggacggccggacagtcccgttccaggcgggccgggtcaccggccggatcccccggacggcgacccagcggccgaccgtggtcccggtggagtgggagcggatgggtgatccgccggcccgccgcccggtccgtgaactgggcaacgggcccaccgacctcgcactgctggccagcgccctggaccgggcctcacgcctggtctcggcgacgcccgtgctgttccccccggccccctgacgtccggcgcgcccccgcgacgcggtattgcgggggcgcacggctcggcgtagaccttgtggtccgggacacatcacgggcatcgggggcagagccatgcgcaggcacggaacgagccgtacgacactcacctggacggcgctcgccgccgcggcggccctcacgctcggcgcgtgcggggacggcggaacggaggagccgcagggtcccgagggcagcacggccgcaccccgggtgcagttaccgaagctgcccggcgagaagctggaggtcgccgcggtctggacgggcccggagcaggagaacttcatcaaggtcctgaaggagttcgagaagcggacgggtgcctccgtcaccttcgtcccggcccaggacccgatcgtcaccttcctcggcacgaagatcgcgggcggtgcgccgccggacgtggcgctgctcccgcaggtcggggcgctggccgcggcggtggagaacaagtgggcgcagccgctgggcccggaggccgccgcccagctcgacgcgaactactcggacggctggaagaagctgggcaccgtcggggacacccggtacggcgtgtactacaaggccgccaacaagtcgctgatctggtacaacgcgaaagccttcgaggcggcgggggtgaagcccccgaagacctggaaggaactgatcacggcggccgacacgctgtccgcctcgggcaccccggccgtctcggtggcgggcgcggacggctggaccctcaccgactggttcgagaacatctacctctcgcaggccggcccggagaagtacgaccagctggccaagcaccggatcaagtggacggacgacagcgtcaagcaggcgctgaccacgctcggcgagctgttcggccgcaaggacttcctggcgggcgggccgagcggggcgctgtccacggaattcccgaagtcggtgacgcagaccttcaccggaggcgaccggccggccgccgcgatggtcttcgagggcgacttcgtggcggtgaacatcgcgcagacgcaggcgaaggtcggcgaggacgccctggtcttccccttcccggcggtcggtgcgaaggctccggtggtctcgggcggcgacgtggcggtcgccctgaagccgtcgaagggggcgcaggcactgctgaccttcctggcctcggcggacgcggcggagatccacgcccgtcagggcgggttcctctccccgaacaaggcggtcgacccggcggtgtatccgaacgacatccagcggaacatcgccaaggcgctgatcgcggcgggcgacgacttccgcttcgacatgtcggaccaggccccggcggccttcggcgggaccccgggagcgggcgagtggaaggcgctccaggacttcctggcgaacccgtcggacgtggcgggcacccaggcgaaactggaggcggacgcggccaaggcctacgggaactgatcccgtgccggcccctgccgccgcacgcgtcccggcggaagtccggcgccgccgtctgatcgcggcggcgttcctcctcccggcgctggtgctgctcggtgcgctcgtcgtgcacccgatcggctactccctctaccgcagcctcttcgaccgttcgggcgacaccttcgtcggcggtgacaactaccgggagatcctgagcgacgacacgatccgcaccgccctgaagaacacggcgctgtgggtggtgctcgccccggccacggccaccgccctcgggctgatcttcgcggtcctcaccgaacgggtgcgctgggggacggcgttcaagctgctggtcttcatgccgatggcgatctcgatgctggccgcgggcatcatcttccggctcgtctacgaccacgatcccgaccgaggggtcgccaacgcggtctgggtcggggtccacgacaccttcgcgcagtcctcggccttccccaaggcgcgcccgggccgggactcgccgctcgcggacgccggcgggggtgccttcgtgacccgcgaccccgtccgcgcgggtactccggtgctgctcccgctggtcggcgtggccccggaggcgctgccggagggaacccgtaccgcgggcagctccggcgccgtgccggggaaggtcacgggcacggtctggcaggacttcacccggggcgggggcggggcggtgaacgtggtcgacccgaccgagcagggcttcgccgggatgcggatcgaggcggtcaaggacggccgggtcgtcgagcggacgacggccggagccgacggcaccttcacgctgtccgggaaggcggacggggcgctgctgcggctgcccgcggccaacttccgggaggcgtactccggggtccagtggctcggcccggcgctcgtcaccccggcggtcatcggggcgtacgtatggatgtgggccggtttcgcgatggtgctgatcggggcggggctggccgccgtaccgcgggagctgctggaggcggcgcgcgtggacggggccggcgagtggcaggtgttccggcggatcaccgtcccgctgctggcgcccgtcctggtggtcgtgctcgtcaccctcgtcatcaacgtcatgaagatcttcgacctggtcttcgtgatcgcgccgggcgcggtccaggacgacgcgaacgtgctcgcgctccagctgtaccggacctccttcggcacggacgccgatccggggctgggcagtgccatcgccgtactgctgctggtgctggtgatcccggtgatgctcgtgaacatccgccgactgcgcaaggaggggtcccgatgagccgttccgacgtgacgccggcccctgcggcgcaccccaggtcctcgtacgccgcgcgcgcgtccgcccggctcgccggcggcgcgctgcgcgtcttcctggtcgtggcggcgctcttctggctgctgcccacgctcgggctgctgctctcctccttcgtctcccccaccgacctcaacagcggcggctggtggcaggtgctgaccgcgccctcacggctgacggccgacaactaccagcgcctgctggcgaacgacaccatcaccggctcgctcctcaacacgttcgcgatcgccgtgccggccaccctgctggtcctggtcctgggctcgctcgccggatacgccttcgcctggctggagttccccggccgggactggctgttcctcgtcgtcgtcggactgctcgtcgtgcccgtgcaggtggcactgatcccggtctccgaactcttcggttccatcgggctgttcgagaccacggcgggcgtggtcctcttccacaccgccttcggactgcccttcgccgtgttcctgctgcgcaacttcttcgcggagatcccgcgtgagctgctggaggcggcccggctcgacggggcgggtgaactgcggctgttcacacgggtggtgctgccgctcggcggcccggcgatcgcctcgctcggcatcttccagttcctgtgggtgtggaacgacatgctggtggcgctggtgttcgcggattccgcccacccgccgatcacggtcgcgctccagcagcaggtacggcagttcgggaacaacatcgacgtgctcgcgcccggcgcgttcctgtcgatggcggtcccgctcgtggtgttcttcgccttccagcggcagttcgtctcgggggtgatggccggagcgatcaagtagccctgcgcgggcgcgcaccccgtgcggcgcggcccgctgacgctgcgtaacccgaatgccacacagcgcgtaacccgatcgccacgccgggggttcctgggcaaatgcccgcgccgacccctggatgtgccgtgccccggttcagcgtcatcgtgcccgcgtacaaggtccaggcctacctccaggagagtctggactcggtcctggcccagtcgtacccggatctggagctgatcgcggtcgacgacgcctctccggacgcctgcgggtcgatcatcgacgagtacgcggcacgtgacccccgggtgacggccgtccacctggcgcacaacctcggcctgggcccggcccgcaacgcgggcctggcgcgggcgggcggcgactacctgatcttcctcgacggcgacgacaccctcgccccgggcgccctgcaggccatcaccgaccggctgaaggccaccggctcccccgacgtcctggtctacgactacgcgcgcaccttctggtcgggcgaactcgtccgcaaccgcctctcccaccggctctccgaggagggcccggccagcttccggctcgccgaccgccccgctctcctcggcatgctgatggtggtctggaacaaggcctaccgccgcgagtacgtggagcgcgagggcctcgaattcccgcccggcttctacgaggacaccccctggacctacccggccctgctggccgcggagtccgtcgccgtcctggaccgggtctgcgtccactaccggcagcggcgcaccggctcgatcctgaccaccaccagccgccgccacctcgacatcttcgaccagtacgaccgggtcttcggccacctcgccacccgccccgagctggagcgctggcgccccgccctgcaccgccggatggccgagcacttctgcaccctgtacgccgacccgcgccgcctcccgcgcgccgcccgggccgagttcttcgcccgggcctgcgccctgctgcgccgccaccgcgtccccgtacccggcggcagcggcgccctgccgctgtccctgtcccggaccgaccgggtccggcacaccctgatgcggctgggcacccggcgcacctaccggctgctgtccgcgctgcgcacggccgcactggcgctgggccgcgccgcctcggccctgtggcggggcctgcgggagtgccggctgcggctgcactaccggatccagcggctgctgccgctccgcccggagctcgccgtcttctccgcgtactggcacggcggctacgcctgcaacccggcggcgatcgaggccaagctgcgggagctcgcgccgcggatgcgcacggcctggatctgcgatccggagcacgccccgaccctgccccgcgagacgacggcgctgcgcccgggctcggcggcgtactggaccgccctggccagggccacctacctggtcacgaacgtcaacttcgaccgcgccctggtcaagcggccgggccagatcctcgtccagacccagcacggcaccccgctcaagcgcgtcggcctcgacctccaggaccgcccggcggccaccccgacgacggacttcgcgggtctgctgcgcggcgccgaccagtgggactacctgctctcctcgaaccggcactccaccctggtgtgggagaaggccgtcccgtcctcctacaccacgctggagtacggctacccgcgcaacgacgtcttccaccgggctggcccggccgaggtgctggagctgcgcgaacgcctcggcatcccggcgggctcgacggccgtcctgtacgcgcccacgcaccgcgactaccggcgcagccggcccgagcacctggacttcgagcgggtgctgcgggagctgggcccgcgcttcacgatcctggcccgcacccatctcacgtacgcggacctcccgccctccccggacacgcacccgcgcctgatcgacgtctccgcgcacccctcggtggaggagctgtgcctggcctcggacgcgctggtgacggactactcgtccctgatgttcgactacgcggcgctggaccggccgatcgtgatccacgcggacgactgggaggcgtacgaggcggcccggggcacgtacttcgacctgcggtcgtgcccgccgggcgcgatcgcccggaccgaggacgagctggtggacatcttcagcacgggccactggcagggctcgcgctccgcgcagctgcgggcggcgttccgcgcgcgtttctgctcgcacgacgacggccacgcggcggagcgggtggtgcgccgggtcttcctcgggcagacggccccgatcccggcggtcgtccccctggaggaccgccgcccggctcccgcggctcctgcggctcccgcgccggctctggcccccgtctggccgtagcgccgcaccgccgggtgggcgcggggcctagggggccagcgcgagcccgccctgaccggcaagacaccccctacgcgtccgggccggagccggccttgaggcccgccaccacctggtgggccaggacgtcgaggtggctgcccgtcaccgcgtcccggacgaccacctggcgccagtagagcggaccgatcagcaggtcgagtgcgtgggcggggtcgatgcccgccgtgagttcgccgcgggcgaccgcatcggagacgatcccctccgccatgcggcgctgcccgtcgagcagggcgccgcgtaccgcctcggcgatctccgggttgcgcgccgcctccacgagcaggtcgggaatcaccgcggaggccaccgggtgccgcagcacgtgtgacatgacctccagcagggcccgtacgtccccgtacagcgagcccgtcgcgggcaccggcaggccgtccaccgcgaaggcccccaccaggtccagcaccaggtgcagcttcgacttccaccgccggtagacggccgtcttgccgacacccgcccgccgggcgatgccctcgatggacatcttcgagaagccgaccgcggccagttcctccaccaccgcgtcacggatcgcctcggtcacgtccgcgcgcaggactgcggcaccggcgggggctctgcgggcgggggcggaaggggcggcggggtccggggtcatgcagagagcataaccgcgcccccgtcacgacgaaacggttgcgttccgacgtgccacgccctaatctcgccgtagcgacgatacggacccgtcccgacctcggcagtgacgtactgccccgtcgaaagcgaaccctgtgaccaccgcgaccgcacccaagaccgcacccgcgccctccgcggaactcgcgcggctcgccgccgcccacggcctcaccctcagcggcgcccgccccacgctcccccgctacatcgcggagctctgggaccggcgccacttcgtgaccgcgtacgcgaccgcccgcatgcaggccacgtacagcacggccaagctcggccagctctggcacctggtgaccccgctgctcaacgcggccgtctactacttcatcttcggcatcgtgatgaaggccagccacggcgtgccggactacgtgcccttcctgatcaccggcatcttcgtctgggacttcatcggcagctccatcaacgccggcacccgcgccgtccacagcaaccgcggcctcgtccgcgccttgcacttcccgcgcgccagcctgcccatctccaccgtcgtccagctcttccagcagctgctcgtcaccatgggcgccctggtcatcctgctgctggccttcggccagcggcccgcctggtcctggttcctggccgtcccggccctcctgctgacggccgtgttcgccgccggctgcgcgatggtcatggcgcgcatcggcagcaagagcccggacgtcagccagctgatgccgttcgtcctgcgcacctggatgtactcctcgggcgtcatgtggtccatcgaccagatgctccagtcggaccacctgccgcaccactgggtgctgaccctgctcaagctcaacccggccgccgtctacatcgacctgatgcgcttcgcgctgatcgacagcttccaggcgcactcgctcccgccccacgcgtggccgctggccatcggctgggccctgctcgccggcgtcggcggtttcatctggttctggaaggcagaagaggagtacggccgtggctgacaccgcgtcgaagagcgacacccgggtacccaccgtcatcgccgacggggtccacgtcatctacaaggtcaacggatccggcgcccgcaagggcggcgccaccgcggcgctcagccgggtcttctcccgcgggccggccccgggcatgaaggaggtgcacgccgtcaagggcgtcaccttcaccgcgtacaagggcgaggccatcggcctcatcggctccaacggctcgggcaagtccaccctgctggccgccatcgccggcctccagccggtggcccacggccggatctactcgcacggccagccgtccctgctgggcgtgaacgccgccctgatgaacgacctgaccggcgaacgcaacgtcgtcctcggcggcctcgcgatgggcatgtccaagcagcagatccgcgagcgctaccagggcatcgtcgacttctccggcatcaacgagaagggcgacttcatctccctgcccatgcggacgtactcctcgggcatgggcgcccggctgcgcttctccatcgccgccgccaaggaccacgacgtcctgatgatcgacgaggccctggccaccggcgacgccgccttccagcgccgcagccaggcccgcatcgaggaactccgcgagcacgcgggcaccgtcttcctcgtcagccacggcatcaacacggtccgcgagacctgcgaccgcgcgatctggctggaggccggtgtcctgcgcatggacggcccctcggccgaggtctgcgacgcctacgaggccttcacccgccgctgaattcagccccgccggcgttcggggcgcgggggtccggggcagcgcccccggcagcgaacaggacggaaacggaacgggccgggcccgggaccaccaaggtcccgggcccggcccgttcggcgaagccgaccgatcagctgtgcacgcgcaacagcgaccgcatcgtccgcatcgccaccgacaggttcgccaggtcgaagtcgtccgacccctggatctcgtccagggtcgtccgcgcccgcccgatgatcgccgcgttcttctcctcccacgccttgaagcgctcctcgggagtcgacgtgccgttgcccaccgacagcacgtccgcggtcagcgccgcgtgggccgcgaacaggtcctcgcggatggaggcacgggccatcgactgccagcggtcggaccgcggcagctcgatgatccggtccatcagctgggtgatcgccaggcggtcgccgaggtcgtagtacacctcggcgacctccagcgggtccacacccgtgcggtcggcgatcgcgacgatgtccagcgccgggaaggcggacgagaagccggccaccttggcggccagttcctccgggacgccctcacccgtcagctcgtccaggatcgactggtaccactccaggtcggcgccgcgcaccagcttcggcagctcggcccagacctgggccacgcgctcctggaagaggccgatggtctcggtgatctggagcggctgcggccggttgttcagcagccagcgggtaccgcgctcgaccaggcgccgcgagtgcagccgcacccgggtctggacgtccgcggcgaccttgttgtcgagcgcctccaccgcgtcccacacatcggccaggccgaagatctcgcgggccgcgagctgcgcgcggacgatctcctccgtggaggccccgctctcctcgcgcagacggtgcaggaaggtcgaaccacccgtgttgacggtgtcgttgaccaggatggtggtgatgatctcccggcgcagcgcatgcgcgtcgatctgctcggtgagccgctcggccagggcgtccgggaagtacgcgaagagcagacggcgcaggtacgggtcgtccggcagctcggtggtgatgagctcgtccgccaccgtgatcttggtgtacgcgaacagcaccgccagctccggctgggtcagccccttgccgccgttcatcagctcgcggatctgccggtcggtgggcaggaactccagcgcccggtcgaggcggccgtcgcgctccagccggcgcatgtagcgctgctgggcgtggagcaggctcggggcctgggccgcgccgttggcgagcgcgacgttctgcgcgtagttgttgcgcaggaccagccggccgacctcgtcggtcatctgggcgagcagcttgttgcgctgcttgacggtcatgtcgccgtcggtgacgaccgcgttgagcaggatcttgatgttcacctcgtggtcggaggtgtccacgcccgcgctgttgtcgatggcgtcggtgttgaccttgccgccgtcgccgcccgcgccggtgcgggcgaactcgatccggccgagctgggtgagacccaggttgccgccctcgccgatgaccttggcccgcacgtcggagccgttgacgcggatggcgtcgttggccttgtcgccgacgtccgcgtgcgtctcggcggtggccttgacgtacgtaccgatgccgccgttccacagcaggtccacgggggactgcaggatcgccttcatcaggtcggccggggtcatcttggtgacgcccgcctcgatgccgagggcctcgcggacctgcgcggtgatcgggacggccttcgcggtacgcgggtggatgccaccgcccgccgagatcagcgaggtgtcgtagtcggcccacgaggagcgcggcagctcgaacaggcggcggcgctcggcgtaggaggtggccgcgtccgggttcgggtcgatgaagatgtgccggtggtcgaaggcggccactaggcggatgtgctcggagagcagcatgccgttgccgaacacgtcaccggacatgtcgccgacgccgacgacggtgaagtcctcggtctgggtgtcgtggcccagctcgcggaagtgccgcttgacggactcccacgcgccgcgggcggtgatgcccatgcccttgtggtcgtagccggccgagccgcccgacgcgaaggcgtcgccgagccagaagccgtaggactcggccactccgttggcgatgtcggagaaggtcgcggtgcccttgtcggcggcgacgacgaggtaggtgtcgtcctcgtcgtggcggaccacgcccttggggggcaggacctcgccggcgaccatgttgtcggtgatgtcgagcagcgccgagatgaagatcttgtacgaggcgatgccctcggcgagccaggcgtcacggtccaccgacgggtcggggaggttcttcgcgacgaagccgcccttggcgccgaccggcacgatcacggtgttcttgaccatctgggccttgaccaggccgaggatctccgtacggaagtcctcgcggcggtcggaccagcgcaggccgcctcgggcgaccttgccgaagcgcaggtggacgccctcgacgcgcggggagtacacccagatctcgaaggccggacgcggggccggcaggtccgggatggcctgcgggtcgaacttcatcgacacgtaggagtgctgctcgcccacgccgttgagctggaagaagttcgtgcgcagcgtggccttgatgagggtgaggaaggcccgcaggatgcggtcctcgtcgagcgaggcgacctggtccagggccccgtcgagctcctccagcatggcgtccacgagctcgctgccggcggtctggcgcacgggcgccatccgggcctcgaagagcgagaccagcagccgggtggtgtggacgttgttgcggagggtgtcctccatgtagtcctggctgaaggtggagccggcctggcgcaggtacttggcgtacgcgcgcaggacgacggcctgccgccaggtgagtccggcgctgagcaccagggcgttgaagttgtcgttctccgcgtcgccctgccagaccgcggcgaaggcgtcctggaagcgttcgcgggcgtcgtcgccgaggtaggtctccccgttgccggtgacgggcatccgcagaccgaagtcgtagatccacgcgctgacccggtcggagcggcgcagctcgtacgggcgctcgtcggtgacctcgacgcccaggcgctgcagcaccggcaggaccgcggagagcgagacctggtccccggtgcggaagatcttgaagcggcgctcgccggggcccgcgccgacgggctcgtagagcgagagcgcgaacttgcggtcgctggcggcgagccgctccaggtggatcaggtcggcgacggccgcgcgcggcgagtggtcggccttgtagccctcggcgaaggaggtgccgtagcggcgcagcagctcggccgcgcgctcctcgccgcactcggcgatcagcgcttcctggaagccgtcggcccaggagcgggcggcctcgacgagacggccctcgatgcgctcgacgtcggagtcggtcagcgcgggcagctcggtgccctgcgggacgcggacgacgaagtggatgcgggagaggatcgactcggtgttccaggcggtgaagtcgacgctgatgccgccgagctcctcgcgcaggatgtccatcaggcgcagccgcacaccggtggtgaagcggtcgcggggcaggtagacgagcgccgagtagtagcggccgtactcgtcctggcgcaggtacagccgcagccggcggcgttcctggaggtacaggacggaggtgacgatggcctggagctggtcgaccggggtctggaacagctcgtcgcgcgggtacgtctccaggatctgcgtcaggtcgcggccgtcgtggctgctcggcgcgaagccggcgccggcgaggacctccgcgaccttgcggcggatgaccgggacgcggcgtacggactcggtgtacgcggcggaggagaacaggccgaggaagcggcgctcgccgacgacgttgccgtcggcgtcgaacttcttgacgcccacgtagtcgaggtacgaggggcggtgcacggtggagcggctgttggccttggtcagcaccagcaggcggtgctcgcgggccttggcgcgcgcgtcggcgggcagccggttgaaggacggcgagaccgggtggccgtcctccttgccgctgtggtgcgggtcggagcgcaggatgccgaggccggtaccgggcacggcggacagggagtcgccgtcgacgaggttgtactcgcggtagccgaggaaggtgaagtggtcgtcggcgagccagcgcagcagctcacgggcctcttcgagctcgtactcgcgcaggtcgggggcggtgggctcgtccgggaggccctccgcgatccgcagcgcggcctcgcgcatcttctcccagtcctcgacggactcgcgcacgtcggacaggacgcgctggagatcggcggtgatctgcttgagatcggccttgtcggtctcgcggtccatctcgacgtggatccaggactcgacgagggagtcgtggggacgcgcggtggcggggccgtgggcgtcgcagtcggggccgaggatctcgatcagcttgccggtgatgtcgcggcggacgacgacctgcgggtggatcacgacgtggatgccgcggccctggcgggacagctcgttcgtcacggagtccacgaggaacggcatgtcgtcggtgacgacctcgacgacggagtggctggaggtccagccgttctcctccaccgtgggcgtgtgcacgcgtacgttcgcggtgccctgcggccggttctcggcgagccggtagtgggagagcgcggctccgaacacatcgaccgggtcccggtccgcgaggtcctctggcgccgtgtgcaggtagtagcgctggaggtaggagagaaccgtgtcctggtccggacgctccccccgctcggccccagtcggaagtagccccccggccgggctgtgctcagctacccgggccgcccgtgcgagcagctcggcctttgcttcgtccagcttggtctgcatgtcctctggctcctgtcgcgcgccattgcgtgacgtaggtgaaggaaggaatgacatagcgccgcgaggcggggtgtccgttcgggatcgacgctatgccgtcgagagagccgaccgggagggaatgagccatgatcggccgaacgtcccgggggcggggatcagcgaaggcccgggcacggtcgtgcgccgggcgcaggccggaggctccagtgcccccgatgactatcgcgctgatcacgggtacaaggctatcccgacctacccccaggacgtcattcgctgcatctgtacaaatcttggggtggaactttgacactctggccagcgacgtgaccggccgtccgtgcagcggcccgtcccgtcgctatccggccagctcgcgagctgtccggacggcctcggccaggctgtccacgaccggcactccggctgattccagactgctgcggctgtgcgagccgcccgtgtacagaaccgcccgggctccgacgtgggcggcggcgagggcgtcgtccacggcgtctccgatgaggaccgtacggtccgccgtcacacccgtcccgtcgagggcggccaggtgacgtacgaggtgtcccgccttggaggtgtgggaggggccgatccggccgtcgacacgcaggaagtgctggtcgatgccgtggtaccggaccagggggacgagcttgtcatggggcgcgagggacagcagggactgggtgagcccctcctgctgccagtcacggagcagctcgcgggcgccttcggcgagcccggcgtcctgggcggcggcccagtagtggcggtggaaggtgtcgtccatgacgagccactcctcctcggtgggcagccggcccatgaggcgctcgtagaacttcggcaccgggacgacgtacaggtcgcggtaggtctccagggtgatcggcgcgaagccgagctcggcgaaggaggcgttggtcgcggctatgacggcgtcgatgtcgtggaggagcgtcccgttccagtcccagacgatgtggttcggggcggtggtggcggtcgcggcggtcacggcggtcgtgtcggtcacttgagcagccccggaatctcctgcacgccgaaccacagcagctcgtggtcctcggccccgtcgacggtgagctgcgcccgcgcgtccccgccgtcggcggcctccagggcccgcgtggcggcggccacgtcctcgtcggcgtcgtcggcgtccacgtgcacggcggcggccacggcgagccgtacggcggcggcgagggtcacctggccgagcgcggcctcgtcggccccggaggtggcggtggcggccttgtcgtcgacgtcgagggcgaccacgacccggcggcgcggggcacccgcgtccgcggcgaccaggcgcagggaggcgagcgcggcccggttcagggccgcgtactccagctcctccatgtcgtccgacacgtaccactcgcggagcccgggggtgacggcgtacgccagcagcggggcggggcccagctcacccgccttgtgcacctcggcgagcccggggagggtcagggggacgtacacgcgcatggccggctgctttcggtagtcggaaacgccctcaggatacgactcggacggggccgggcgggtgagggactccgtcccccttcggggccccggaccgggagccgcgcccgtccacccgagtacgcgaactggcgcctccgggagccggggaccggccgccgcccacccggataggtgaagcgggccggcggccgggcgggccgcgggcgtggttgcggagcgtgtgcggcggccgtagaagatccccatcaagttaccgcccggtaccgctccgggcccggacttttcggggggcagctcgcgatggacaccacgacgcgcggcacgatgaccggcaacgacggcggccgccgacggcccgccggccggacgcggacccggccggcgggccggcgcgacccccggcgcccggccgcggccggacccccgcgcaccctgcgcctgggcccgcaccactggttcgccgaacacctcctcgcggtggtcagcggcctgcgcccggtccactcgctcctcggccacaccatcggccccgcctaccagcagctgatcaccctggccccctcggaccccctccgcgaccgcctgcgcccggtcgtgcgccagtgcggccgcttcatcccgggccccggagtcatcgaggccttcgcccgcatcgccaccggcgaccgcctcacggccatggccttccgcctcgaacagggcccggacctccgctggcgctgcgcagcggtggaaatccggggcccccgcccatgaggcggtccttccgcctcgcaggcgatcgaggcgcggggtccggggcggggccccggcggcagcgccgcacccgtacacgacgcggccggggccggacaccccaggtgtccggccccggccgacagttccagctcgccgacggcggcgggttacttcttccggcgacgcccgcccgcggccttctgcgccttgcgccgctccgcccgcgtcatcccgtcgccctcgccaccggcggcgtcactctcgaagtcgccctcgatgacaccgcccgccccgtccacggtcggggcggagaagtgcagccggtccggccgctgcggagcgtccaggcccttcgcccggatctccggacgggcacccgccggctccttcgtcagcgacggcgccgcgtcctgcaccggaagctcctcgacctgctgctcgacctggacctccaggttgaacaggtagccgacggactcctccttgatgccttcctgcatggcgttgaacatgtcgaagccctcgcgctggtactcgaccagcgggtccttctgggccatcgcccgcaggccgatgccctcctgcaggtagtccatctcgtacaggtgctcacgccacttgcggtcgagcaccgacaggaccacgcgacgctccagctcacgcatgatctcggagccgagcgtcttctcacgcgtctcgtactgctcgtggatgtcgtccttgacggactccgcgatgaactcggcggtgatgcccgcgcggtcgcccgcggcctcctccagctcgtcgatggtgaccttcaccgggtagagctgccggaaggcgccccacaggcgctccaggtcccactcctcggcgaagccctcgaccgtctcggccgcgatgtacgcgtcgatggtgtcgtccatcatgtggcgcacctgctcctgcaggtcctcgccctccaggacgcggcggcgctcgccgtagatgacctcacgctggttgttgaggacctcgtcgtacttcaggacgttcttgcgcgtctcgaagttctgggtctccacctgcgactgggccgacgcgatcgcgcgcgtcaccatcttgttctcgatcggcacgtcgtccgggacgttcgccatcgccatgacgcgctcgaccatctgcgccttgaacagacgcatcaggtcgtcgcccagcgacaggtagaagcgggactcgcccgggtcgccctgtcggccggaacggccgcgcagctggttgtcgatacggcgcgactcgtgacgctcggtgcccagcacgtacagcccgccgagctccttgacctcctcgaactccgccttcacagcggcctccgcccgggtgagcgccgaggggagcgcgtgcgcccactcctcgatgtgctcctccgggtccaggccctgctggcgcagctcggcctcggcgaggtcgtccgggttgccgccgagcttgatgtcggtaccgcggccggccatgttcgtggcgaccgtgaccgcgccccggcggccggcctgggcgacgatcgtcgcctcacggtcgtgctgcttggcgttgagcacctcgtgcgggatgccgcgcttggagagctgctgggagaggtactcggacttctcgaccgacgtcgtaccgacgaggatcggctggcccttctcgtgcttctccgcgatgtcgtcgacgacggcggcgaacttcgcgacctcggtccggtagatcaggtccggctggtccttgcggaccatgccgcggttcgtcgggatcgggacgacaccgagcttgtagatctggtggaactcggcggcctcggtcatggccgtaccggtcatgcccgacagcttcgagtagaggcggaagaagttctgcagggtgatcgtggcgagggtctggttctcgtccttgatgtccaccccttccttcgcctcgatcgcctggtgcatgccctcgttgtagcggcggccggcgaggatacggccggtgtgctcgtcgacgatcatgacttcgccgtcgatgacgacgtagtccttgtcgatcttgaagagttccttggccttgatcgcgttgttgaggtaaccgacgagcggggtgttcaccgactcgtagaggttctcgatgccgagccagtcctcgaccttggcgacaccggactcgtggatggcgacggtgcgcttcttctcgtcgacctcgtagtcgccggtctcctcgatgcccttcagcggctggccggcctcgcccttggtcaggcgggtcaccagcttcgcgaagtcgccgtaccacttcgtggcctggtcggcggggccggagatgatcagcggggtacgggcctcgtcgacgaggatcgagtcgacctcgtcgaccacggcgaagttgtggccgcgctggacgagctcgtcctgggaccacgccatgttgtcgcgcaggtagtcgaagccgaactcgttgttcgtgccgtaggtgatgtcgcagctgtactgctcgcggcgctgcgccggcgacatgttcgccaggatgcagccgacctccaggccgaggaacttgtgcacccggcccatcagctcggagtcgcgctcggcgaggtagtcgttcaccgtgatcaggtggacgcccttgccggacagcgcgttcaggtacgcgggcagcgtgccgacgagggtcttgccctcaccggtcttcatctcggccacgtagccgaggtgcagcgccgcaccgcccatgatctggacgtcgtagtgccgctggccgaggacgcgcttggccgcctcgcgtacggtcgcgaaggcctcgggcagcaggtcgtccaggctctcgccgtcctggaaacgctgcttgtactcgtccgtgagcgctcgcaactcggcgtcggagaggttgacgaagtcctcttcgatggagttgacctggtccgcgatgcggtgcagtttgcgcaggatcttgccttcgcctgcacgcatgagcttgttgaagacggacaccgaggtttgtctccttgccggtcgggcctgggcactgtacgtacacgggcacggcaggtgggccccaccgcaacggccatcgtaagcgaggacgtggccgcgtcgggaggtccgccgttcccgcgagggcacgggtgcccgtattgagaacgtacgggggacaccgaaggtgccgcaccacccggagggatcaccgaaatttgttcgccgcgggcgtcggcccggcagcagaatcgcttcatggagcccacgacactgagcacggaccgattggtactgcggcctttcgtcctcgcggacgaggccgaggtctacgccgcggcacaggacccggacatccagcgctggacgctggtcccctccccctacaagaaggaggacgcgcacacctgggtgaccgagaccgcgcccggcggctggcgcgccggcacggccttccccttcgccgtacgcctgggagccgcgggcccgctggtcgcgtccgtcggcctgcacgtccacagcgcggagagctacgaggtcggctactgggcggtcaaggagcaccgcggccggggctacatgaccgaggcggtcctggccgtcgcccgctgggccttcaccgagctcggcatcgggcgcctggagtggcgggccgaggtgggcaacacgggctcccgcgccgtggccgagaaggcgggcttccaggtcgagggcctcctgcgggccggcatcatccagcgcggcacgtaccgcgactgctggatcggtgccctcctcccctccgacctgggcctgaccccggcgatgccctacctcccaccgaccgccgcctgaccggtccgctgtcagtggcaccgcctaggcttccgcgcatgaccagcctgccgccgccgaccgtgtccctctccgccgacgaggcccgccgcatcgccctgcgggcgcagggcttcctcggggcacccgaccgccgcggaggggtccgcggggtcctgcgccacctgggcgccgtgcagctggacaccatctcggtcctggcccgctcgcacgagctgatcccctacgcccgcctgggcgcggtcggccgggacaccgtggagcaggcctactggtcggaccggcacgccttcgagtactggtcgcacgcggcctgcatcctgcccatcgaggaatggccgcacttcgcgttccgccgccgggcccgccgggcgcgcggccaccgctggcacgtcctgcaggacaaggagcgctcgacgcgggcggtgctggaccggctccgcgccgacggcccgctgacctccaccgagctgggcggcgccaagaacggcggcgagtggttcgagtggtccgagaccaagatcgcggtggagtggctgctcgacaccggcgaggtggtgtgcagcgagcgccgcggctggaagcgggtctacgacctccccgagcgggccgttcccgacgcgctgctccacgacgacttggacgaccgcgagtgcgtacgccgcctggtcgccctggccggccggtccctcggggtcggcacccgcgcggacatcgcggactaccaccgcctcaagggcgaggagttcgacgcggtggtcgcggaatccgggctggtcccggtcgaggtggagggctggtccaagcccgcgtgggcggacccggcggcgctcgcggaggcccccaggggccgccaccgcacgacgctgctgtcgcccttcgactccctggtctgggaccgcccccggaccgagcggatcttcggcttcacgcaccgcctggaggcgtacgtgcccaagcccaagcggatacacgggtacttcgcgatgccgctgctggcgggcggccggctccagggccgcgtcgacccggcccgggagggccgcacgctggtcgcccggcagctctcgctgacctccccgaaggccgcgggcccgatggctcaggccctgcgggaggccgcggaatgggtcggctgtgacgaggtgcgcgtcgagcgcgcgagttcacccgcggaagccgcggccgtcacggcggaactcgccgcgcgctgagcgccgccgggtgctgccgggtgctgccgggtgccgccggacgatcaggtcagcggatttcgagaatcttttcccgcatcgcgtagaccacggcctccatcctggagtgcagctgcagcttctccaggatgttgcggacgtggttcttcacggtgttctcggaaatgaacaactgcttggcgatatcacggttgttcataccggtggccaccagtttcaggacctcgagttcccggtccgtcagcctcggcgcgggcaccagccgccgctcgtccgtccgctggatcatcgacttgaactcggtgagcagcttcgacgccatcgacggactgatctgcgactggccgtccgccaccgcccggatcgccgtggccacctcgtccgtcgagatctccttcagcaggtacccggtcgcacccgccttgatcgcgtcgtagaggtccgcctcctcgtcgctgatcgtcagcatgatgatcttcgcggagggggccacctccttgatcgaggtgcacgcctcgatcccgccgcgccggggcatccgcacgtccatcagcacgatgtccggaagcaggtcggccgccttgtccacggcctccgccccgtccccggcctcgccgacgacctggatgtcctcctcctgcgcgaggacgatctccagtccccgccggaacagcgcgtggtcgtcgaccacgagcaccctgatgggctcccgggcgggctcctgcgtcgggtccgtcccgcggcagcccgcgacgtcgccgtccccgcgcaccggcccgaagctgtccgccatcgttcctccccctgcatgtgctcagtcgctgggccaaccggacacacaccgcagccggttgactgcacgccatgattccatgcccgcaccacggcgcgggggccacaagtgcgccacctggcgcatacccgtcgcacacccgtcatgcaggtgcccccgcgcaggcgccgtggcgcctgcgcgagggcgacgaaacggtgtgccctgcctcagccgccgagcgcgccaccggcgccgccccgcggctcctccgaggtggaggcaccgtccgggttcacgtggatgacgccgtagtcataggcatggcggcggtagacaacactgggcatcttcgtctcggagtcgacgaacagatagaagtcgtggccgaccagttccatctcgtacagggcctggtcgagtgacatgggtgcggccgagtgggtcttctcgcggacgatgagcgggccttcgccctgcacctcgatggatccgatccgggtgatcggtaccccgtccgtcttctcctcggacaccggctgaccgctgccgttcagcgaggcgacgcccggcaccacgtcggcgacctccgccgccgagagccggccgttgccacggcgggtgtaacgcttgtcgtgctgcttgcgcagccgggcctccagcttgtcctgagccaggtcgagcgccgcgtacgcgtcggcggcggcggcctcggcccggatcaccgggccccgcgaacgcagggtgatctccacgcggtcggaacggtcggcctggcgcgggttgtgctccttggacacctcgacgtccaagctgatcaccttggcgtcgagcttctggatccgctccggattcagcttctcggccacgtgcttgcggaaccgctcgggcacctcggtcttgcggcccttgacgacgatgtccacgcagaactccgttcccggatagctccgcccgacggggcgaagcgtctccctttcgcaccagactccggtgaaggccggagcctcggacttggcgactttcacctcctcctcccccatcggcaagatcaacaccccaccgacttcggagtcgggagacagcctcctgagttccttacaaccgaacatatccctctcgggcggttgtcggcacccgctaccggaatgtacttccatccaggtggctgttccctcttactacctgcaacgatgggccttccccgccagttccaaatctattcacaagatttttgttctgtccgagttgctcaaacacgtggcgcccgttcgatccgcctgaaggagtccgccggcgcggccaccaccgccgcccgcagcgccgcccccggactcgcccccgcgcccgccgccgggcccgtcaccagccccgcgacgcgcaccgcccgcgccgcctccgccagcgtcgcccccgtggtgatcaggtcgtccaccagcacgatccgggccgccccggccgtgagccgccacccgccccggcgcaccgccagtgcccccgcgaggttctcccggcgctgccgcgcccccagccccgcctggtccgccaccgcccgccgcagcgccagtacgggcgccacccgcgcgggaacaccggcccgccgcagccgccccgcggccgccagcgcgatcctgcgcgccggatcgtgcccgcgcgcccggacctgccgccgcgccgacggtacgggcaccagcaccacgtccccggcgccgcccgggccgccacggccacccgccaggacggccgccgccagggcgccgccgagcaccccggccagcggcagcgccccgcgctccttgtgcgccagcaggaggctccgtacggccccctcgtagacggcggcggcccgcaccgccggcagccccgcggggctgggagacggccgcaccggcccctccccggccccgctcagcacctcccggcactcggcgcacaccagcacccggagcgccccgcagccggcgcagtcgaccggcagcaccagcccggcgagctcctgccaccacccccgcatggctccacactgacgggccgggccacggcccgcgccccctgtggacaacccgcgaccgcgggacggatcagcccgggtacaccggggcccggccgcccagcgcggccgtacgccactgcgcccccggcggcagccacacgatcccgtcctccgagaacgcgaccaccggcttcggcttcgcctcgtcctccatggccgcgaccgccacctccgacagcccggtggccccgggcaggctcgccgcgaccatcgaaccgtcggccagcatgtagcgggcctgctgcacgccgcccttctcccggcccaccaccagcaggcggccgcgcggtgcccagctcatcgccgtcacgtcgatcatctgcggagccgccgggcgcagctcgcgcaccgacaccgccgagacgtcacccttgccgtcgggccgctcgatccgccccacgtagaggatcttgttgccgtcggcctccgccaccagcagcgcgatccgcgccccgtcggcggacaccttcagcgaggtgatcttccggccgtcgagccccgccacctgcaccttctccggggtcccggcgccacccggcacccgccacagccccatcgactgcggatcccggtcggcgacccacacgtcgcccgaagcgtcccagctcggcgcggtcagcatcgccgacttgccgcccctgccgatcggcagcggctgcggcatcgggccgcccccgaccagcggtacgacgtacagcgcgtgctcgtcctccgagaccacggccgcgtgccgctcgtcgtgcgagaccgccgccgacctgaccttgaacccgggaggagtggccagcggccccggcaccggttcgggccggatctgctgctcctcgctgctcgtgtccagcttcatccggaccagccgctgctcgttgtcgacgaagtactggaactcggggatcttggggcggcccgcgatcgcggccgcgttcacctcgctcaccgagcacagcgacgtcgacttgccgcccgcccgcaccagttcgacctggtcgagccgggagcccgtcagatccttgaccgtgtacaggagttgggtggccatcttcttgcactgcggctgcgcgacgttctcggccttctcgttgagcggcacgcgcagcgtgttctgcccgtcgtacgaaagggacttggtgcccgggctgagttccgtaccggtggggaagctggactccacgaccggggcgagccaccgggacggcccggccagcagcgactgcacggtctgcgtggtggggtccatccgcgaatcgggatcggtgcgctgacgcacgtagaccgggtcggcgacgagcgagccgcccgcgaagtagtacttgttgaccggcatgtagatgcgctggaagtccgactcgctgagcacgagcccgctcggcggggtcgagatccgccactgctcgtccttgtcccggaccagctggaggaactcctcgtagtcaccggccccggtctccggctggtacgcactgtgctcgtcgacggtcgcgagcttcttcccggtcaccttccagcggggcccctcggggtccttctcccccctgttcgggacgcggttgaggccggaggacagcaccgtgacggcggagccgggcttccagctcttcgcggcggcctcggtgaggtacttgcgggcggtctccagctgcgggtcgtcgctggtcatcgcctccaggaagccgtcgacgatctccgccgggctggccttgtccgcgggcggtacgccgaacacccggacctgcgagtccacgccctgcgaggcctgcaccgggcggatgtcaccgctgtccggcatggaggcgcagccggcgagcagcagtccggccgtgccgaaggcccaggcccgtacggtgcgcagccgccggagccggacccgcgcacgccccgcccgcgcgtccaagggctcagcgtccatcggctcggtcctcctgttgtgcctgctcggccgggcgggccacgacccgggccccgttccccggcagggccgtcgggtcggcgggcaccggcatcgctccggcgacgggcgagcgcggcggtatcggcgaacggtcgccggcgtcggcgggcgtacgctccgccgcgccgcccgcggcctcggcggcggccctggcccggttggcgcggttggcccgggaatcctcgggctccagcgggatgggcgagccccgcagcggctcgtcggccgtgcgcggcagggtcaggcggaactgcgagccgccgcccggctcgccccaggcctgcagccagcccccgtgcagccgggcgtcctcgacggcgatggacaggccgaggccggtcccgccggtcgtgcgcgcccgcgccgggtcggcccgccagaagcggttgaagacacgggtggcctcgccgggcttgagcccgacgccgtagtcccgtacggcgacggcgacggccccgcccgcggacgccagccggaccaccacgtcgcggccctcgccgtgctccacggcgttgacgaccagattgcgcaggacccgctccacccgccgggcgtcggcctcggcgatgaccggctgggtgtcgcccaggacccggatccgggtgcccttgtgctcggcgagcggctcggcgccgtcgatgacccggcggaccacgtcgcggaggtcgatgggctcggcctccagggccgcggcccccgcgtcgaagcggctgatctccagcaggtcggcgaggagcgactcgaaccggtcgagctgcccggcgagcagttcggcggaacgcgcggtgatcgggtcgaagtcgacccgggcgtcgtggatgacgtcggcggccatccgtaccgtcgtcagcggggtgcgcagctcgtgcgacacgtccgagacgaagcggcgctgcatccgggacagctcctccagctgctggatcttgttctggaggttctgcgccatcttgttgaaggcctcgccgagacgcgcgatgtcgtcctcaccggtgaccttcatccgctcctggagccgcccggccgagagccgctcggcgatcccggcggccatccggaccggcgtcaccacctggcgtacgacgagccaggcgatgccgcagagcagaacgacgacgaacaggcccgcggtcacgatcgtgaccttgatcaggttgagggactcctcctcctgcgtgagcgggaagaggtagtacaggtcgtacgggtcaccgttgatgtccgagagccgcttgccgatgaccagcgccggctcgggctccttggccccgtccccgctggtgtagcggatctcggagaaggtcttgaacgcgccggtggcgtggttgacggcccggcgcagccccagcgggacgctggcggtcggatcgacgttgccggaggccctggcgcccttgacgccctgcgtcccgggcagcgcctcatcgcccgtgcccgcgcccagcgcgacgacctcgaacgcggtctgtccgccactggccaactgcttgaccagggagttcatccaggtactggcgtcccggccgatcttgttgtcggtcgcgtcgggcccgtccaccgtcgccggggcgttggccttctcctgcgccaccgcgaacccgcccgcggcctggctctgcgccgcctcctccttggcttcgaggagacccttgctgacctgggcgatgacgacgaaacccagggcgaggaccacggcgagcgagatcagcagggtggcggcgaccacccggagctggatgttgcgccgccacagccggacagccggaagcagcggccggcgcgccaggcgcaggaacagccgcagtacccggctgctcgacgcccggtcccggaacagccggccgaagcgcagcttccacgggcgggagccgcccgggaccctgccgggcatgccggaagcgccggactgcacgtcagctgggtccggccttgtagccgacaccgcgcaccgtcacgacgatctcggggcgctccggatccttctcgaccttggagcgcaggcgctgcacgtgcacgttgaccaggcgggtgtccgccgcgtgccggtagccccagacctgctccagcagcacctcacgcgtgaagacctgccagggcttgcgtgcgagggcgaccagcaggtcgaactccagcggggtcagcgcgatggaggcaccgtcccgcttgaccgagtgcccggccacgtcgatgaccaggtcaccgatggccagctgctcgggcgcgggctcctccgaccggcgcagacgggcccggatgcgggccaccagctccttcggcttgaacggcttcacgatgtagtcgtcggccccggactccaggcccacgacgacatcgaccgtgtcgctcttcgcggtgagcatgacgatcggcacgccggactccgcccggatcaggcggcagacctctatgccgtcccttccgggcagcatgaggtccagcagcaccaggtcgggcttcgcctcccggaaggcagcaagtgccttgtcaccgtccgctacgaacgacggctcaaaaccttctccacgcagcacaatgccgagcatctcggccagcgcggtgtcgtcgtcgacgacaaggacgcgtcccttcatggttgacatcatcccattagctaatcgttacccggcggtgagctgtcccacagccaaaagggctggaaatcgaccctcggacctgcgtggagatcagccccaccagtctgcccccgatcgggtcgactattgaaggtacgggctgcgaagaccccgcagtaccgcccggaaccgtccgaccggtcggcatccccccgaaccggccctccccgccccgccaccgcccccgatccgccgcccaccccctactccgttcgggccccccacgtggcacgatggcagcgaccagcgccccgccgcggcaggcgcacgtgaaggagtgacgatgaacgactctccgggctgggctacgcccggatcctctccgtccgacgacgagcggccgggcaccgacggcggcgcgcaacagcccacaccgcccgcacagcccgcgcagcccgcgcagcccgccggcgaccccaagtggtccgccgagcagccgccgcccggtcagtggtcgagcccgggcaccacgcccgaggccccgcagacagcacagaccccgccgcagcccaccacgggctggggacagcagccaggcaccccgcaggcgggccagtacggctcccagtacggctaccagggcggccccggccagtggggccagccccccgccgcgaagcccggagtgatccccctgcggcccctgggcctcggcgagatcctcgacggcgccatcgccaccatgcgcacccactggcgcgcggtcctgccgatcaccctcgtcgtggccaccgtcgtccaggtgatcagcgtgatcgtgcagaagatcatgctggacgacttcgccatcagcgcggacccggacgccggccccgaggaactgatcgactccatcggcagctccctcggcgcgtcggcggtgatccagttcatccaggccctcggaaccatcgtggtcaccgcgctgctcaccatggtcttcagccgcgccgtgctcggacagcactcctcggtctccgacgcctggcgcgaggcccgcccccagctgctgcgcctgatagggctcaccctgctgatggccctcggcgccgtcctgctcggggccgtactggtcctgccgggcatcctcaccgacaccgtcggcctcgccgtcctcggcttcgtcctctggctgccgctcctggtctggctgggcgtcaagttcagcctggcctcgcccgccctgatgctggagaagagcaccgtcttcaaggccttcgcgcgctcctcgaagctcgtcaaggacacctggtggcgcatcttcggcatcacggtcctgaccacgatcatcgccggcttcatctcggcgatgatcgtcgtaccgttccagatcctcggtgtcttcgccttcggcggcggcctcgacgcgctcgcggacggcgactccaccggcatgaccaactggggcgcactgatcgcccccgcgatcggcctgatcatcgcgcagaccatcgtcatgccgttccagtccggcgtcaccgtcctcctctacgtcgaccagcgcatccgccgcgagggactcgacctggaactcgcccgggccgccggcctggagaactacggcacgaccggaggctgacgcacagatgatgagtacggggggcctcatcacccgcgccacggcgctcctgtccggcgacgggacaccaccggtgacgacaccgcgcgaacccgccagggaggcggccgagcacgaactgtccaagccgatgtaccacgagaacgacccgggcctgttcgaccgcgccctgcgcaagttcttcgactggctcgacgacctgctcggcgccgcctccggggcgacccccggaggcggcctcggcctcctcgtgatcctcgtcctcgtggtcctcgccgtcggcgccctctggtggcgactgggcacccccggccggatcaccaccggcgccggcgacctcttcgccgacggcccccgcagcgccgccgagcaccgcaccgccgccgaagcccacgccaccgccggccgctggaccgaagccgtccaggagcgcatgcgcgccgtcgtccgctccctggaggaacgcaccctgctcgacccgcgcccgggccgcaccgccgacgaggccgccgccgaagccgcggtctccctccccgaccacgccgcggagctccgcgccgccgcccgcaccttcgacgacgtcacctacggcggccgcaccgccgacgccgacacctacgcccgcctgcgcgccctcgacctcaccctggaccgcgcgaagccgctgctgacgggacccaccgcatgaccggcccgaccgacccggccgcgccggcgcccctttcggccccgccggcgcccgagcccgcgcccggcgcccccggcgacggcggcggccccgccgaccgggccgcccgcgccgacggcgacccgcgcacccgccgacgccgccagatccgccgcgccctcaccgccgtggccgtcctcgccgccggcgtcatcgccacggccgccctcaactccggtacccgccacggctacctcgacccccgctccgccgacccctccggcagccgcgcggtcgccgagctcctgaaggaacgcggcgtcaccacccgcgccgtcaccaccgcccgcgaggcggccgacgccgccggcccccgcaccaccctcctggtcaccgaccccgaccggctcggcaccacccagcgcgacatcatccgctcggccatcgacctctccggcggccgcaccgtcctcctcgcgcccagcagccacagcctcaccggcctctcccccggcgtgcgcaccgccggcgccgccgacacgaaccaccccgacccgggctgcaccctgcccgccgccacctcggccggccgcgcggacaccggcggcggcctccgctacaccaccaccctcaccgggaccaccgcctgctacccgagcggcggcgaccccaccctcctcgtcctgcccaccggcccgaccggcggcgacaccgtcctcctcggctccgagacgatcctcctcaacgagtccctcgccgacgagggcaacgcctccctcgccctccaactcctcggctcccgcccggacctcgtctggtacctgccgtccctcgcggactccgaccccgccaccgcgccctccgaggacaagggcctcctcgacctcgtcccggccggctggtcctgggccctgctccagctcttcgtcgccgccgtcctcgccgccctctggcgcgcccgccgactgggccccctcgtcaccgagaagctccccgtcgccatccgcgcctccgaggccaccgaaggccgcgcccgcctctaccgcaaggccgacgcccgcgaccgcgccgccaccgtgctgcgcgccgccacccgcgaacgcctggccgccctggtcggcgtaccgcacacccaggcccacgaccccgcggcactggccccggccgtctccgcccgcctctccggcggcccccgggacgtgaccgccctcctcttcggcaccaccccctccgacgacgcggcactcgtcgcgctcgccgaccacctcgacgccctcgaaagagaggtccgtacgtcatgacgtacccggccaccgagtccacggcagtgaccgcggacagcgcccgcgcttccctcgaagcgctccgcaccgagatcggcaaggccgtggtcggtcaggactccgccgtcaccggtctggtcgtcgcgctcctgtgccgcggccacgtcctcctcgaaggcgtccccggcgtcgcgaagaccctcctcgtccgggccctggccgcctccctcgaactcgacaccaagcgcgtccagttcaccccggacctgatgccgagcgatgtcaccggctcgctcgtctacgacgcccgcaccgccgagttctccttccaggacggcccggtgttcaccaatctcctcctcgccgacgagatcaaccgcacccctcccaagacccagtcctcgctcctggaggccatggaggagcgccaggtcacggtcgacggcactccgcgcaagctgcccgaccccttcctcgtcgccgccaccatgaacccggtcgagtacgagggcacgtaccccctcccggaagcccagctcgaccgcttcctcctcaagctcaccgtccccctcccctcccgcgaggacgagatcggggtactgacccgccacgccgccggcttcaacccccgcgacctgcacgccgcgggcatccgccccgtcgccggcccggcccagctcgaagccgcccgccaggccgtcgcccaggtctccgtatcccccgagatcgccggctacgtcgtcgacgtctgccgggccacccgcgaatcgccgtccctcaccctcggcgtctccccccgcggcgcgaccgccctgctggccaccgcccgcgcctgggcctggctcaccggccgcgactacgtcacccccgacgacgtcaaggccctcgccctgcccaccctgcgccaccgcgtccaactgcgcccggaagcggagatggagggagtcacggccgacgccgtcatcacggcgatcctctcccacgtccccgtcccgcgctgatggccctcaccggacgcgccgccctgctggcggccctcggcagcatcccggtcggcctcctcgaaccgagctggaccggcatgctcgcggtcaacggcccgatcgcactggcctgcgcactcgactgcgccctggcggcccccgtacgcggcctcgtgctggcccgctccggagacacctcggtccgcctcggcgaaccggcggacgtccacctcaccctcaccaacccgagcggccgcaagctgcgggcccgcgtccgcgacgcctggcccccgagcagctggctcccgggcaccgagaccgccgcgtcccgccacgaggtggtcgtccccccgggcgaacgccgccggctgaccacccgtctcctgcccacccgccgcggcgaccgccaggccgaccgcgtcacgatccgctcctacggtccgctgggcctgtgggcccgccagcgctcccaggcgtccccctggaccgtccgggtcctgccgcccttcacgagccgcaagcacctcccgtcccggctcgcccgcctgcgcgaactcgacggccgcaccagcctcctgacgcgcggtgagggcaccgagttcgacagcctccgcgactacgtccccggtgacgacacgcgttccatcgactggcgcgccacggcccgccagaacaaggtggccgtccgcacctggcgtcccgaacgcgaccggcacatcctgatctgcctcgacaccggccgcacctcggcgggccgcgtcggcgacgccccccgcctggactccgccatggacgccgccctgctgctggcggcgctggccacccgcgccggcgaccgtgtggacctgctggcccacgaccgccgcccccgcgcccaggtccagggccgctccgcggccgacaccctcccgtcgttcgtcaacgcgatggccaccctggaaccggagctggtcgagacggacgccaggaccctggtctccacggtcctccgcagcgccccgcgccggtccctcgtggtcctgctgacgagcctggacgcggccccgatcgaagagggcctgctcccggtactcccccggctcacgcagcgccacacggtcctgctggcttcggtcgccgacccgcatgtcgcggccatggcaaacgcacggggttcggtggacgcggtctacgaggccgccgccggcacccagacccagtcccagcgccgccgcaccgccgatcagctcagccgccacggcgtccacgtggtcgacgccaccccggacaccctggccccggccctggcggacgcctacctcgccctgaaggccgcgggccgcctctaggccgtctcttccggagtgatcgcgctcagcttgccgatgggccaaggggccattcgatggcgtgccgctggcccgtggacatgcatgccgcctgcgccaaggcgggctgtgcgtcccccgagaagccggcgaagtagatgacgctcgccgcaccatggaggccggagctggtgctgctcgtcccgggccgctcacggccgctgccgaatccctccccggggcttcaactcagctggtcgcgcacgagatcaaggaatgcctgtcggctcggatggatgtgcgcccagaccttctcatcctgtggctctcccgggtcttcgggacccttcctgatcacctcctgcactgcccacgcgaggctgcgtgccgcttcgctgacctcggacgcgcacagtacgtggatcgtcttctgcgtcacccacaccctgtcgaggacctgactggcccgggcctgccactgctcgtcagccaggttgtggtgataccgatccaccgcaactcgttctgcttcctgcaccgcagacagaaatgcgatgaggtgcgtgagccgttcgttgcggcgcgcctcggcacgttcacggacactgcggcgcgcctcgccgcgttccaaggcgcgtcctgccgagcgttgggccagcatcgacatgagcccgccgagcaggacgccgatgagcggcgcaagcgttgtccacacaacgtccgattatgacatcgatggcatgaacacggcacggggtgaaatcggtgcggcaactgatcgagtcggtgaacgacaccctcaaaggccggctcgacctggaacaacacggcggccggacctttgagggcgtcaccgtccgcgtcgcccaacgcgtcctcgcgctggccgcagcaatctggcacaaccacaagaccggacagccaatcacacggtccctgatcgcctgactcatcgaggggtgcccggctccataccctggccgggcacccaccaggaggacacatggccgacttcacccccgagcaggtgcgcgcatgcacgacttcgcggaaaagctcgcggagctggccgagcaccacgaagaccagtggaaggtgcaggccaccgatggtcagatcttcctcacgatgatgagccccaccgccgctcacgggctcaacgtgatgcggctgcgtcgtcagatcgaggcccagacactcgacgtcgtcgctctcagcgacaccaacatgagcgatccggtgaccagcctgaccaagatcgccgatctgttgatcatggtcgaggaagacgccgatgacacagcgaaggccgtcaactcgcgtgacgtgcagatggtgctggaagtcgtctcccgcacgaattccctcaccgacatccgcgacgagttgcacgactacccgaggatgggggtccctctgtacgtcgtcgtggatccccgtaaggacaagaagtccgtcaccgtgcacagtgacccctctgaggggcccgacggcacgcgctaccgaaagacggttccctacgctttcggggacagcgtcaccgccggccgctggacgctcgcgacgagcagtctcaagggctacccggccgactggtaggtcacggccgcagccgcgtccgaaccggccacggccgtaaacgcagaaaagccccgcaccataaggtgcggggctttcccacaatgattgttcggcggcgtcctactctcccacagggtcccccctgcagtaccatcggcgctgaaaggcttagcttccgggttcggaatgtaaccgggcgtttccctaacgctatgaccaccgaaacactatgaaatttgaacacgctggcatggacacagctgttcgttatttcagaactaacacagtggacgcgagcaactgaggacaagccctcggcctattagtaccagtcagcttcacccgttaccgggcttccacatctggcctatcaacccagtcgtctactgggagccttaccctctcaaggaggtgggaatactcatcttgaagcaggcttcccgcttagatgctttcagcggttatccctcccgaacgtagccaaccagccatgcccttggcaggacaactggcacaccagaggttcgtccgtcccggtcctctcgtactagggacagcccttctcaatattcctacgcgcacagcggatagggaccgaactgtctcacgacgttctaaacccagctcgcgtaccgctttaatgggcgaacagcccaacccttgggaccgactccagccccaggatgcgacgagccgacatcgaggtgccaaaccatcccgtcgatatggactcttggggaagatcagcctgttatccccggggtaccttttatccgttgagcgacggcgcttccacaagccaccgccggatcactagtcccgactttcgtccctgctcgacccgtcggtctcacagtcaagctcccttgtgcacttacactcaacacctgattgccaaccaggctgagggaacctttgggcgcctccgttaccctttgggaggcaaccgccccagttaaactacccatcagacactgtccctgatccggatcacggaccgaggttagacatccagcacgaccagagtggtatttcaacggcgactccacaaccactggcgtggctgcttcaaagtctcccacctatcctacacaagccgaaccgaacaccaatatcaaactgtagtaaaggtcccggggtctttccgtcctgctgcgcgaaacgagcatctttactcgtagtgcaatttcaccgggcctatggttgagacagtcgagaagtcgttacgccattcgtgcaggtcggaacttacccgacaaggaatttcgctaccttaggatggttatagttaccaccgccgtttactggcgcttaagttctcagcttcgcaaccccgaaaggtcactaaccggtccccttaacgttccagcaccgggcaggcgtcagtccgtatacatcgccttacggcttcgcacggacctgtgtttttagtaaacagtcgcttctcgctggtctctgcggccacccccagctcacggagcaagtccgatcaccagtgatggccccccttctcccgaagttacgggggcattttgccgagttccttaaccatagttcacccgaacgcctcggtattctctacctgaccacctgagtcggtttagggtacgggccgccatgaaactcgctagaggcttttctcgacagcataggatcatccacttcaccacaatcggctcggcatcaggtctcagccttaatgagggacggatttgcctacccctcggcctacacccttaccccgggactaccaccgcccgggctggactaccttcctgcgtcaccccatcgcttacctactacaagtctggttcgtcggctccaccactttcctttccccgaagggtccggaacggcttcacggacttagcatcgcctgattcgatattgggcgtttcaaagcgggtaccggaatatcaaccggttgtccatcgactacgcctgtcggcctcgccttaggtcccgacttaccctgggcagatcagcttgacccaggaacccttagtcaatcggcgcacacgtttctcacgtgtgtatcgctactcatgcctgcattctcactcgtgaaccgtccacaactagcttccgctgctgcttcacccggcacacgacgctcccctacccatcacagcgggcgttggccctattgctgcaatgacacgacttcggcggtacgcttgagccccgctacattgtcggcgcggaatcacttgaccagtgagctattacgcactctttcaagggtggctgcttctaagccaacctcctggttgtctctgcgactccacatcctttcccacttagcgtacgcttaggggccttagtcgatgctctgggctgtttccctctcgaccatggagcttatcccccacagtctcactgccgtgctctcacttaccggcattcggagtttggctaaggtcagtaacccggtagggcccatcgcctatccagtgctctacctccggcaagaaacacacgacgctgcacctaaatgcatttcggggagaaccagctatcacggagtttgattggcctttcacccctaaccacaggtcatcccccaggttttcaaccctggtgggttcggtcctccacgaagtcttacctccgcttcaacctgcccatggctagatcactccgcttcgggtctagagcgtgcaactcaatcgccctattcggactcgctttcgctacggcttccccacacgggttaacctcgctacacaccgctaactcgcaggctcattcttcaaaaggcacgcagtcacgacccattgggtaaacccaatgagcgacgctcccacggcttgtaggcacacggtttcaggtactatttcactccgctcccgcggtacttttcaccattccctcacggtactatccgctatcggtcaccagggaatatttaggcttagcgggtggtcccgccagattcacacgggatttctcgggccccgtgctacttgggagattcttaagcaagccgctgatgtttcgtctacgggggtcttaccctctacgccggacctttcgcatgtccttcgactacatcaacggtttctgactcgccgaccggccggcagaccgatcaaaagaattcccacaaccccgcatgcgcaacccctgccgggtatcacacgcatacggtttggcctcatccggtttcgctcgccactactcccggaatcacggttgttttctcttcctgagggtactgagatgtttcacttcccctcgttccctccacactgcctatgtgttcagcagtgggtgacagcccatgacgactgccgggtttccccattcggacacccccggatcaaagctcagttggcagctccccggggcctatcgcggcctctcacgtccttcatcggttcctggtgccaaggcatccaccgtgcgcccttaaaaacttggccacagatgctcgcgtccactgtgtagttctcaaacaacgaccagccacccatcaccccaccagacaagctggcgagttcactggggccggcactgaagacatgaccttacggccgtaccttcaggacccaacaacgtgccaagcatccccgttcatccgtcttctctttccacgccgaagcagtacttgagaaccatcagaccgaagatgccaactaatcaacgttccacccatgagctgaccgtgcagaacgtttgtctgcaatcggtactgtgctccttagaaaggaggtgatccagccgcaccttccggtacggctaccttgttacgacttcgtcccaatcgccagtcccaccttcgacagctccctcccttacgggttgggccaccggcttcgggtgttaccgactttcgtgacgtgacgggcggtgtgtacaaggcccgggaacgtattcaccgcagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccgagttgaccccggcggtctcctgtgagtccccatcaccccgaagggcatgctggcaacacaggacaagggttgcgctcgttgcgggacttaacccaacatctcacgacacgagctgacgacagccatgcaccacctgtataccgaccacaaggggggcactatctctaatgctttccggtatatgtcaagccttggtaaggttcttcgcgttgcgtcgaattaagccacatgctccgccgcttgtgcgggcccccgtcaattcctttgagttttagccttgcggccgtactccccaggcggggaacttaatgcgttagctgcggcaccgacgacgtggaatgtcgccaacacctagttcccaacgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagctagcccgtatcgaatgcagacccgaggttaagcctcgggctttcacatccgacgtgacaagccgcctacgagctctttacgcccaataattccggacaacgcttgcgccctacgtattaccgcggctgctggcacgtagttagccggcgcttcttctgcaggtaccgtcactttcgcttcttccctgctgaaagaggtttacaacccgaaggccgtcatccctcacgcggcgtcgctgcatcaggctttcgcccattgtgcaatattccccactgctgcctcccgtaggagtctgggccgtgtctcagtcccagtgtggccggtcgccctctcaggccggctacccgtcgtcgccttggtgggccattaccccaccaacaagctgataggccgcgggctcatccttcaccgccggagctttcaacccccgcccatgcaggcaggagtggtatccggtattagaccccgtttccagggcttgtcccagagtgaagggcagattgcccacgtgttactcacccgttcgccactaatccaccccgaagggcttcatcgttcgacttgcatgtgttaagcacgccgccagcgttcgtcctgagccaggatcaaactctccatgaatgtttacccgtaatcgggtgcacacatcacttagagcgggcgcatcatgtcggaatatgaccgacgcgccacaacgtcctcgctgtgttgttgcctgcaagtgcaccggcgaaccggagccttacaggtctttttcaaaggaacctcatccaccgaagtggacggggtatcaacttctggcgttgatttttggcacgctgttgagttctcaaggaacggacgcttcctttgtactcaccctcgcgggctttcctccgggctttcgttctgttcttgcgtttccgactctatcagactctttcgtgtccgacttcctcggcgctttccaggtttttcgctttcgcgctttccctttccggcggttccgactctatcagaagttctccaccggatttcccggcttcggattcctgaatgaggagtcggctgtaccccgctggaattcaattccttatcggggtgagagagagtttaaaccatcgctgccgaacttgtccagttcgaggcaaccgttcgaatctacctccccgcgcgctccgtgtcaacggtcttcgcgggacgacgaggagactagcagctcaacaggcttgtacgcacatcaggccgcggtcgggagcgtcgccgtctggtcggcggcctccacgtcgcccacgtcgccggcgcgcgcggccctgccgcccaggatgaagacgtagaggaggaaggcgacctcggctgcgacgccgatcgtgatgcgggcccaggtggggaggcccgacggggtcacgaagccctcgatcaggccggagatgaagaggaccaccgcgaggccgatggccatgccgagcgcggtgcggccctgttccgcgagggccgtgcggcgggtgcgggggccggggtcgatgaccgtccagcccaggcgcaggcccatgcccgcggccacgaacaccgccgtcagttcgagcaggccgtgcgggaggatcaggcccaggaagacgtcgaggcggcccgcggaagccatcaggccgaggccgacgccgaggttggccatgttcaggaagaggatccagagcacggggattcccaggaacgcgcccaggaccaggcagatcgccgccgcctgggcgttgttcgtccacacctgggcggcgaaggagcccgcggggtggctggagtagtacgtctcgtactcgccgccgggctgggtgagcgccttcagttcctcgggcgccgcgatcgcgccctggacttccgggtgcgtggcgatccaccagccgatgagcacgccgagcgccgtggagagcagggccgtgggtatccaccagcggcggctgcggtagacggcggccgggaagcccgccgtgaagaagagggcggcgtcgcgccagccggcccggcgggtgcccgtcaccgtggcacgggcgcgggcgaccagctgggtcagccggccggtcagcatcgggtccggggcgctggactggatccgggagaggtgggtggaggtgcgctggtagagggcgacgagttcgtcggcctcctcgccggtcagctttcggccgcggcccaggagctgctccaggcggtcccactccgcacggtgcgctgtcacgaagacgtcgagatccatccggttgccgctcccctgtcccaggtcccctggccactgcctattcctagtgtggtcagcttggcagactggatgacgtaggggcggggggcaggtcacatgagaggtgctgtggtgagcgatctggtgacgggggacgcggtcgtcctggggctcaggcccgcgcggctgccgagccgcgggctggcgatcctcctggacctggccgtgtacgtcaccggatacgtactcatctccgtcgggctgaccatggccaccgcctcgctggacgaggcggcccgggcggcggtgtcggtggcgagcttcctgctggtcctggtgggtgtgccgatcgcggtggagacgctgtcccacgggcgttcgctcggcaagctcgcctgcgggctgcgggtcgtacgggacgacggcgggccgatccggttccggcacgctctggtgcgcggggccatggggatcgtggagctgatgctgaccttcgggtcgatcgcgtgcatcgcctcgctggtgtcggtgcgggggcggcggctcggtgacgtgttcgccgggacgctggtggtccgggagcgggtaccggggacccgggtgatgccggtgcctccgccgccgccgtggctggcggggcggttcaccgggctggatctttcggcggtgccggacgggctgtggctggcgatacgccagtacctgacgcggatgaaccagttggatccgcaggtgggtgccgcgatggcggtgcggctcgcggacgatctggtggcgcgtacgggggctccgccgccggccggggtgccggccgccgcgttcctgatggccgtggtgcacgagcggcagtcgcgggacgccgcccgggcgttccggccgtccgccgtgggccctggccacgggttctcgcccgccccggtaccggggccggtgcccgtcgtcgcgccggtgccctacgcggctcccgcgccggtggcacccgtggcacccgtggaggctccgcgggccggcgggttcgcgccgcccgcctgagggatcactgctcctcgaaggccgagggcggcgtctccaggtgttcgagttcgatgccgggggccgagagcaccacgtccccggcgatgtggatcgtgtggacctcgcccgtgtccagggcgctgacctggtactcgtccaccagcagcgggccgctgtccgtggggtgttccgtgcgggcgacgagggcccacgcctggtcgaccgtacggggtgccaggaccgggtccgtcagggccaggagccggacgcgggtggcgggggcgccgggggccgggcgcagcaggcgggccgtggcgacgaggaaggccggggaggtgccggtgaagccgggggcggcgatgttgccctcggtggcctcggtgccggtggggtcggtacggacccaggtgacgccgtcgatggcggcgccgcgcacctgccagctcgcggcgttgatctccatgcggatggggcggccgagctcgtcgatcgccaggtcgacggaaccgcggtggtccccgtccggtccggtgagctgggagacgtagcgccagccggagggcccgggggcgcagtggaagtgctcttcgccgagcggggtgtggtcgtgcgggtcgtggagcgagtagcggccgcggggcatggtgcgcactcttcttcggatcgagggggacacggggcaggcccccggcacgggtgccgggggcctgctgcacgttctgctggtttccgctgatcaggtggcgatcagggggtgatcagtagcggtagtggtccggcttgtacgggccttccacctggacgccgatgtaggcggcctgctccgggcggagcgtggtgagcttgacgccgagggcgtcgaggtggaggcgggcgaccttctcgtcgaggtgcttcgggagcacgtagacctcggtcgggtactcctgcggcttggtgaagagctcgatctgggccagggtctggtccgcgaacgagttcgacatcacgaaggaggggtggcccgtcgcgttgccgaggttcagcaggcggccctcggagaggacgatcaggaccttgccgtcggggaacttccaggtgtggacctggggcttgacctcgtccttgacgatgccctcgaccttggccaggccggccatgtcgatctcgttgtcgaagtggccgatgttgcccacgatggcctggtgcttcatcttggccatgtcggcggccatgatgatgtccttgttgcccgtggtcgtgatgaagatgtcggccgtctcgacgacgtcgtcgagggtggcgacctggtatccgtccatcgccgcctgcagggcgcagatcgggtcgatctcggtgacgatgacgcgggcgccctggccgcgcagcgactcggcgcagcccttgccgacgtcgccgtagccgaagacgaccgcgaccttgccgccgatgaggacgtcggtggcgcggttgatgccgtcgatcagggagtggcggcagccgtacttgttgtcgaacttcgacttggtgacggcgtcgttcacgttgatcgccgggaacagcagggtgccctcggacatcatctcgtagaggcggtggacaccggtggtggtctcctccgtcacgccgcggatctcggaggcgagctgggtccacttctggggggactcgccgagggtgcggttgagcagggtgaggatgtgggcgtactcctcggagtcggccgtcgacgggtccggggccgagccggccttctcgaactcgacgcccttgtggacgaggagggtggcgtcaccgccgtcgtcgaggatcatgttcgggccgccggtgggggtgttcggccaggtcagcgcctgctccgtgcaccaccagtactcctccagcgtctcgcccttccaggcgaagacgggaacgccctgcgggttctccggggtgccgttcgggcccaccgcgatggcggcggccgcgtggtcctgggtggagaagatgttgcaggaggcccagcggacgtcggcgccgagggcgacgagggtctcgatgagtacggcggtctgcacggtcatgtgcagcgaaccggtgatgcgggcgccggcgaggggctgcgcctccgcgtactcggcgcggatcgacatcagacccggcatctcgtgctcggccagggtgatctccttgcggccgaacgcggcaagggagaggtctgcgaccttgaagtccatgggtgctgctcctcatggttcgagagggtgggtacggctgggccgtgcgccgtcctggggacggggcaccgagcacagtccgtcgggggtcctctctcccctcggccggtcgcagggaccgcccgacccgccatcagcagcgacgcctgacactgggcacgaatctacaccgaccggcggagtctgccccagtcagccggagaactggccgcgtctttccctggggcgccccggggctcctcacgtggtgtgacaccccgtcggcggggccggcgtgatcggcccgtacagttcggccgcacgtcggatcgaacggaagcaggggcggggaatgggaaagcaggaccgggtaccgggacggcgactcggggtggcgtcggtggcgatgctggtgctgggggcgcttctgggctgcgtcgggggtctgggcgggtacttcttcatgccgacgaaggtcataccgtcggaccacatgaggccgaccctcaccacgggctcgtcggtggtcttcaacctgctgaccgtcaaggtgaaccgcggcgacgtggtgctcttcgacgcctcggcctggggtgagcagcaccagtccgtggaacgggtggtcgcggtgggcggcgaccacatcgcctacacccccggggaccggacgctgaccttgaacgggaagccgctggacgagccgtacgtactgaacggcgatccggtggcggggtcgcccggcccgttcagtgtgacggtgcccaagggccggctgttcgtgctgggcgacaaccgcggcaactccgccgactcccgcttccggttccaggattcggagagcggaaccgtgcccctgtcggacgtgaacggcgcgctggtcgaccagggcgatccgctgctcgtcggcctgcggtccgcggcactcgccggcctcgcggtgctgtgcgccggtgcgctgttcggcgccgtcgcgctgcggctgcgccgccgggcggcggcggccgcggtgcacccggcgtacgcggggctggtgccgccgccggggggctgagggccccgtgaacgcccgaaggcccccgcgggcagctgctcgcgggggccttcgggcgttcacggccacgtgcctactgggcggcttcggggcggtagatgtccggctccaggtagatgacccgggcgatcgggacggcctcgcggatgcgggcttcggcggcgttgatcgcgtcggccacctgggtcgcggtgtcgttgccctcgaccgcgatcttggcggcgaccagcagctcctccgggcccaggtgcagggtgcgcatgtggatcacgcgggtgacgacgtccccgtcgacgaccgcggccttgatcttctcgacgtcctcgacgcccgcggcctcaccgagcaggagcgacttggtctccgcggccaggacgatcgcgatgaggatgagcagcacaccgatgcacagggtgccgatgccgtcccagatcccgtcgcccgtcagcagggcgaggccgacaccgccgagggccaggaccaggccgacgagggcgccgaagtcctccaggaggacgacgggcagctcgggggccttggcccgccggatgaactgggtccacgtgagcttgccgcggatctcgttcgattccttgatggcggtccggaaggagaagctctcggcgacgatcgcgaagaccaggacgcccacgggccagtaccaggcctcgatggggtgcggctcgtggatcttctcgtagccctcgtagatggcgaacatgccaccgacggtgaagagcacgatggagaccaggaaggcgtagatgtagcgctcgcgcccgtacccgaaggggtgttgcggtgtggcctcgcgctgcgccttcttgccgccgagcagcagcagcccctggttcccggagtcggccagcgagtggacgctttccgcgagcatcgacgaggagccgctgaagaggtatgccacgaatttggctacagcgatggcgaggttggcggcgagtgccgccacgatcgccttggtaccgcccgacgcgctcatgggtgcagggtgtccttcctagccactgactaccggccgcacattgttgcagccggtgggagggacgctacgtcagaccaccacggtggcgcggaagaccgtaccgcttccggacagttcgaccttttcgcccgccggtacgaagaccgaatcccccgggttcagggccagttcgccggcctgcggagagcccgccgtgcagagcaggatctgcggggtgtcgtgcgggagcaggcgggaggcgccgccgggcgcgaggaggaagcgggagagccggaactcgtcgatgggggtctcgtagacctcctcgccgtcgccctcgggccgcagcaggctggggtcgcccggctcgaacttcgcgaccttcagcagctcgggcacgtccacgtgcttgggggtgagcccggcgcgcagcacgttgtccgagttggccagcaactcgacgccgaggccgtcgatgtaggcgtgcgggacgccggcgccgaggaacatcgcctcgccgggctggagtcgtacgtggttcagcagcatcgcggcgatgacgcccgggtcgcccgggaagtggtggaccagcgtggcgtacggggcgtaccggccgccgaggcgcgtgacggcggtggcgacgtcgtgcacggtgtgggccatctcggcgcggtccgcggtcagtacggccgtcagcatctcgcgcagggcggcctcttcggggtgcgcgcgcagcaggtcgacgtacggcttgaggctgtccacgtccaggcccgcgaggaggtcggcggcctccagcggcggccggaagccgcacagcccgtcgaacgcggtgagcgcgcagatcatttcgggcttgtggttggggtccttgtagttgcggtggtccgcgtcgatcgggaccccacggcgctcctcgtccgcgaaacccgcccgggcctggtccaggtcggggtggacctggagggagagcggggcgccggcggcgaggatcttgaacaggaagggcagccgggggccgaacttggcgacggtggcagcgcccagctcgccttcgggatcggcggcgatgacgtccgagagcgcccgctcgcccgctccccggtcgatgcgggagggggcggccgggtgggctcccatccacatctcggcctggggctcaccggtgggttcgacaccgaggagcgtggggagggccgtggtggatccccaggcgtaggggcggatcgtgttcgtcaggcggtccatcgtcgtcttcctggatagagctgggtacttccgtgcctcagctgtgtcccccggaagccaacgccaggtaggcggtggcgaaatccgtgacggcgaggagttcggcgagctgctccagttcgacgccctcctccggttcgagctcgctgatcgccgtgtcgtggctgtgcgcgagctcgcgtgcggcgggggcggcggtgaggccaccggccggccggtcacgcagcaggacgatgcgggcgcgaagggcctggggctcttcgacccggtcacggaagaagtcgtcggggtcggcacccgcggcgaaggatcccgcgagcaggacgccgtgggcgggcagcgcctcgggaagcacggcggccagggcggggcggccggcgagctcggcgagggtcgcggcgaagcggcggcccgcgggggcggcgccggtgccctcgctccagatcagggggagcgtgtcggccagctcggcggcgagggtcttggccgggttggagtaggtggcgatggcgggcccgcagcgttcggccgtccggtcgagccggtcggcgacgagttgcagggtgtccggggcggcggtgatcaggccgaccttgtcgaggagcagcagcagcggcgtcagcagggcccagagggcgccgggtccggccgcggcggactcgtcgtactcctggtacggggccttggccatcggtacgaggagcccgtgcgcgccgtccaccgcctcgctcagcggtgagcgctcgggggcgacggcgacgacggtgcagccgcgccggtacgcctgctcggcgaggaccgcgagcccgggctcggtgccgtcggtggtggtgaggagcagcaggtcgacgggtccggcccagccgggcagggcccagcgcagtgcgccggcagcgtgggcgacgccggtgggctccagccggatgacgggcgcggaggccccggcgagggcgccgagcaggtcggccacgccggtggcggccgtgccgggcccggcgatcaggacggagcgcgggcggccgtcggggcgcagctcggcgaggccggcctcggtcgcgtgccgggcggcggtacggactctggcgcccgcctcggccgcaccgcggagcaggccccggcggtcgacgcgggcgagatcgtccggtgcgtcgaggagcgactcgtcgagcatggcggcctccggcggtgttgacggatccagggtggcggaatcggtctcagcgtctgcgtctgcccgtgcttctcgggcgcggcaggggtcaggcggggcggcgggcctcgtccacgaggagcacggggatcccgtcccggaccgggtacgcgaggccgcagtcctgaccggtgcagatcagctcgggcgccgtctcgtcggccgacttgtcctcaaggggcgagtggcaggcggggcaggcgaggatctgcaggaggccggcttcgagcggcatggggcgattcccttcgggcatgtgggtggggcgaggtcagcgtaccgccgagtccgtggcggcgcggtgtcgtggggcggggttcgggcgggtcccggggctgcgccccgggacccggcgcgggagcgcgtcaggcgcggatgagggccaggacctcgtcgcgaaccttggccagggtggcctcgtcacgggcctccacgttcaaacgcagcaacggctcggtgttcgaggcacggacgttgaaccaccagtcctcggcggtcacggtcaggccgtcgagctcgtccagcgtgacaccctccgcgctgccgtaggtcgccttcaccgccgccagacgcccggcctggtccgcgaccgtcgagttgatctcccccgaacccgcataccggtcataggaggccaccagcgccgacaacggaccctcctgaccacccagcgccgccagcacgtgcagcgccgccagcatccccgtgtccgcgttccagaaatccttgaagtaatagtgcgccgagtgctcaccaccgaagatcgcacccgtcttcgccatctcctccttgatgaaggaatgacccacccgggtacgcaccggcgtcccgccgttctcacgcacgacctccggcaccgaccacgacgtgatcagattgtggatcaccgtgcccgacccgccatgacggcccagctcacgcgccgcgaccaacgccgtgatcgccgacggcgaaacacccacaccccgctcgtccacgatgaagcagcggtccgcgtcaccgtcgaacgcgatacccagatccgcaccctccgccagcacccgcgcctgcagatccaccacgttcttcggatccagcggattcgcctcgtggttcgggaacgtcccgtccagctcgaaatacatcggaaccacgtccagcggcagaccctcgaacaccgtcgggaccgtgtgaccgcccatgccgttgcccgcgtccaccaccaccttcagcggacggatcgacgccacgtccaccagacccttcaggtgcgccgcgtagccgggcagggagtccagctccgtgaccgaacccgccaccgtgcccgccggaacaggcggagcaccctcgtccgaccacgtctcgaccagctcacggatctgcgacagacccgtgtcctgacccaccggagcagcacccgcacgacacagcttgatgccgttgtactgcgccggattgtgcgacgccgtgaacatcgcacccggcagacccagcgaacccgacgcgtagtacagctgatccgtcgagcacagcccgatcagcgtcacgtccacaccacgcgccgccgcaccccgcgcgaacgcagccgacagacccggcgacgaaggccgcatgtcatgaccgatcacgatcgccgcggcgggaacgacctccacgaacgccgcaccgaacagctcggccagggactcgtcccactcgtccggcacgacaccacgcacgtcgtacgccttgacgatgttcgaaagatctgcggccactgcctgccctcctgaaggtcctgtgcggttcagcaaaacctaccctgaaccaggagtggctcttcaggccatcggagcgtcaggaatcgggcgatctcaggacgcgcaggtgtccacgacgggtctcgccggtggacgggccgccctggccggcccggccggcctcggccgtgcgcccgggcgggcgggcggcttcgcggacggcgttggcgagggcttcgaggtcgtcgccgctggggcgggacggcccggagccgtcggacaggcgcacgacgtcccagccccgtggggcggtcaggcgctccgagtgctcggcgcacaggtcgtagcagtggggttcggcgtaggtggcgagcgggccgagaactgcggtcgaatcggcgtagacgtacgtcagtgtcgcgacggcagggcggccgcacgcagtgcgcgaacagcgacgtacaaggctcacgacgttggacggtaccgcactcttgaccgggccgcgacgactccaccgccgctcactcccccgtgtcgtgctcggagctaccctgcgggagtgacggacacccctcttcctccctgccccgccgagccccccgcagggtcccggaccgagccgcgcccacgtcggcgggaccggcacgggcgcgggatgcgcggtccgctggcaccccctcaggtaccgctggcggccagccggtcggagctgttcggggatctcgtacgggattccgtggagcggctggagcggcgctggccgcagctggccgaggtcgagttcctgatcggtgacgtgccggggccgccgggcggtccggacggcggctggaacgacgaggcggtgccgctgggtgcggtggccgagtcgcgcgaggggcggcccgcccggatcgtggtcttccgccgaccggtggagatccgtaccaagacgcgggacgagaaggcgatgctggtccacgagatcgtcgtggagcaggtggccgagctgctgggtctctcaccggagacggtggacccccggtacggcgagaactagacggcccgggccgaggcccagagcccgtcccgctgtcgcgtaccgggggcgccgcttcatccgggtgtcatccggtcaggaccgagaggtcctgggcggccttcgggacggagaccgtggaatggtcgtccgagagtccctggacggtgaacatcgcgattccctcgtgcgggagggacagggtgcgggccgcgtggaccgggccgcccgagagggtctcgacggtgagggcgtaggagcccttgccgcccgccggggccagggacaccatctgcgtggtgcccgccttgaccgtgacctcctgggaggcggcctcgccgccgccggtgcccggcgaggcggtcaccttgaccttcgcgtcggcggccggggccgtcagggccagcagggtggtgttctcctcgggccggttgtcggccaccgtcgcccgtgcgccgaccggcctggtggcggggatgaagccgatctcctgcttggcgccgctgccgcggaccacccgcagggcggcgacgaccggggcggacttcttggcgtcggacggggccagcagcagcgagccggcctccccgcgggtcaggtccttgaggtccacggacgccgtcataccggccttgacgtgcagctgctcgctgcccgccgggctgatcgagccgcccggtccggccaggcgcaccttgaggtccgcgtcctcctcacccggtacgaaggcgacgagccgtacggaggtggcgtccgccgggatgcccggcaggacgagcgagcccgccgggtcggcggcggccggcagccagtcggctcccaccccctcctcgccgacctggaccgacgcgccgacccggcccgcgcgcgtggtcacgtgggcggtggcgtccgcgagctgggcgcccgggacgagggaggacagcagcacggccttggtggacttggggtcgacccggatgctctcgctggtgccggcgtcgggcttggccggaccgtccgggccgaagatcttgatgtcgacgatggccgcggcgtcgtcggggttggtgaggtggacgtagtcctcgcgccccttggccgtgctgaccgcggggaaccagaagtcggtgccgggtgcggtgcagccgacgccgaggacgccgcgggcccggccgaccgagaccttggtggtcagctgcgcggtccagccgggggcgagggcgccctcggcgctgccggtgagggcgggtgcgtcggcgcccgcggcggtggccccgacgggcttgcccggctccttggcctccagcaccggcttggcgtccttggtggcgccgagcagccgggccgagcccttgccctcgccggccggggcgccgggggtgaaggccgtgtacgtggtctcggcgatgtccgaggagctgggtcccgggcacaccagcagggaccgctccaccggcatccgggcggcggccgccgacttgccgtcggccgccttgccgtcggcggcgggcgcggtgagggcggcgacgccggtgatggcggccagggccgcggtcaccgccgcgagcgtcaggggtgcgcgctgcttcactgctgggagctcccgtccggacgcgggtcgtgcggtgcgtgggggtggtgggggtcgtacggctggtacggctcgtacgggtaggggtactgctgctggtccgggtcctggaccggctggtgctgcggctgctgcgggtacgggtcctcgtacgcctgcccgttctgaccccgctgaccgccctgctggtcgtactgcgggtacggctcgtacggggcctgctgctgcggctcgtaggcgtagccgccctggtcgccgtacgcctggtacgcgtagctgtcgtcgccgtacaccggctgtgccgggatctgcgcgtacgggtcggcggccgcggcggtctccaccggtacgggggccggttcggcctcggcgcgcagcctgcgggcgcggcggccctcgccggcctcgcccgggccgggctgggacgggagcgcggcctcctcctccggcaggtcgtcgtcgagctccgcgcggcggccgggcagggccatcaccagcaggaccagggcgagcaggccctgggtccagtaccaggcggtctgcagcagggagtcctcgtggacgaggtcgaggcggccgccgtcggcgggcagttcgaagccctgcgcccagccgtcgacggtcttgggcttgaggggcttgccgtcgagggtggcccgccagcccgcgtcggcccggtcggcgatgcgcaggacgcggcccgcgtcaccggcggggatcttgctgtgggcctctacgggtccggcggcgaccgggatcggggcctcgccctgcttgccggagacgatgaccgcgcggggcagccacggttcgacgccccacagggcggtgccgtcctgctggtggcggcggctgaggcccggggtggcgtcgaggacgcggcggatgtcctcggggccgccggggcggaacatcacgaagcggatggcgtaggcgctgagctggctggactggtcggcgccggagccggcgacgaggttggagacgaccttgtcgaggcgggcgtcgccgccggtgcgggcggcgacgtccgcgtcgccgatgcgcccgccggagccgcggacgaggctgtaggagacggaggcgggcgggtccaggtcgaggaccagggtgcgggtctggttgtcgtcgccgcccgcgtccgcgacgaaggccgggacctgtacggggtcacgtcgctgcagcgggccgtcggcgccggcgagcatccaggtgaggccggcgaccagcggtcccgcggcggcggccagggcgatgagggcggccagcggctggcgccagccgaagctgcgggcggcgacgcgttccttggcaccgtcggcgccgagggcggcggccgcgagcagggcgagcccgtagacgagggtggcggggccggcccaggcggtgcggttgaggacgacggcgaggagcagcccggcgagggcggcggcccaggcggtgcggacggcgaaggcgcggtcggtgcgcagcagggcggccagggcggcgaggacgatgccggcgagcaccgctccggggccggtgccggggccgccggggctcagggcgagcaggccgagggcgtcggcggagccggtcccgtagggcagtccggcctcgtgcaggaggcggccggggtgcgtgagcaggcccagcgaccagggggcgagtacgacgagggggacggcgagggtggcgagcagtcgcaggccgtacgccttccagtgcgcgcggcgcagcaccagtgcgccggtcccgaggacggcggccagcggccacacgacgggggtgaaggcggtggtgagggtgagcagcagcgtgtacgtccacaccgcgcgccggccgccccgccggtcggtggcttccgcgccgtcggcgaggtcgaaggcggcgacggcggcgcgggcgaggaggggcagtacgacggcgaggaccgcggtgccgaggcggccgccggcgagggctccggtcacggcggggaggaaggcgtaggcgatggccgcccaggcgcgcagcagccgggattcgacgagcggccgggaggcgaagtaggcggtgaggccggcgagcgggacggatccggcgagcagcagggtcagggccgcctgggtggagccgaacagcagggtggcgagggtgccgaggacggccaggtagggcggtgcggagacggtggagccggtgccgacggcgtgccagccgtcggtgtaggcggcccagaggtcggagccgctgccgggggcgggcagcagggcgccgcccatgagggagccgccgccgatgaggccgcggcaggcggcgagggagacgagggccaggagggcgaggaggacgggcgcggggttgcgggcgagccgcttgaggcgggcgaagcgctcggcctccaccaggtagtcgccgtcctcgccgggggcgtcgaggacgctgcctccgccgtgccggcccgcgggggcggaggcggtgtcgcggtcgctgccgaagtagccggcgagctgttccgcgttggcccgcagggaggctcccggcggggggaagagcgggcgcagttcggcggcggggacggcggggcggcggcgggccttgcgggcggcgaggagccggccggggcggagcagggtggcgagcaggccggtgagctcgtcgacggcctggccgggggccttgccgatgaggtaggcgagggtgcgcagcacggtgccgagcaggacgcgcagcaggacgtagggcagggcgcggccggagctgttggcgaggatcgtgtagacggcgccggccttgtcgacgcggtgcgggccggccgcggtgcgtccggcgcagtcgacggtgcggcgttcgcgggcggaggcctcggcgtgccgcaggacggcgtcgggggcgacgaggacggtgtggccggcgctctgggcgcgccagcacaggtcgacgtcgtcgcgcatcaggggcaggcgccggtcgaagccgccgagctcgtcgtagacgtcgcggcggaccagcatgccggcggtggagacggacaggacggggcggacctggtcgtgctggccctggtcctgttcgcggcggtcgagtccggtccagcggcggccgctgcgggcgatggtgacgccggcttcgaggagctgcttcttgtcgtaccagccgcgcagtttggggccgatgacaccggcgtcggggttgtcctcggcgacgcggagcagttcggtgagggcgtcgggttcgggggcgctgtcgtcgtgcaggagccagagccactggacgggttcgccgtgagggagctcggggaggtcgtacgcgtcgtcgcgccaggtgcggctgacgggatcccagccgctggggcgctggaggtacgggaggtcctcggggctcagggtgcccgcgctgcgggcggactcgtcgaccgcggtgccgaagccggtgcgtcgggcgaggtgcaggacgtggtcgtcgccgaaggcttcggtgagcaggcgcgcggagtcgtcggcgctgccggtgtcggcggcgatgtggttctgcgcggggcgttcctggcccaggaggcccgcgagcgtccggggcagccagcgggcgccgtcatgggcgacgaggaccgcggtgacgacgtgccgggggaactcgggtgtggccggggcctggtaggaggccgtcgactgactgtgcagggacatcgcggtacgggccctccggccgggggtccgggggtggtgtgccctcggaggctgctggacagcgccccaccctaacggctgccacgacagcggtccgcctcctgcggggaaggtgcaggaggcggaccgtgtgccgtgccgtgtgtcgcgctcgtcgtcccgtccggcgcgctgtccgtcatgcgccgaagtgcgttccgtcgtgtgctgtgtcgtgcgttcgctatgccgtgcggcgcgcggccgggccgtttcagaccgctgcctttttcaggcggcggcgttcccgctcggacagaccgccccagatgccgaatcgctcgtcgttggcgagggcgtactcaaggcattcggagcggacctcgcaggcgaggcagaccttcttggcctctcgggtggagccgcccttctcgggaaagaaggactcggggtcggtctgggcgcacagagcgcgctcctgccacccgagctcttcgtccgcctcctcgaccagcagttcctgaaacagctcggtcatgtgcgcccctcgctctgtctgtgcgtccccgtgacgatgtcgtcactgattgctacgtaacgacacgagtgaaattacaagtgcgtggctccggggcagtcaagccgagatctgctattgggccccttattcactctgcggaaccaagcgtatgcagaaagtgttcatatcgccaaaaatcgtgacacatgccaccggcatcacgggatgcccgcctttacccgtattccacgtgccacctccgggtggggttgcggtccggccggagaagcggcgcagatcacattcaggtcacggaagtcgggatcgggtttgagcgccgacacagcgccacatcccctgccgcacactgcacaaacctttctccgtgcacggtaaccggatgaggtgaaacttttacaccaaaccggacattgggttgacagtccgacctccgagccgttctccttgttcccatgtcagcgcccgcagccaccacccggacccccattcgtgggttcctgtgcgctgcccaggttcgctgttgctgttgcagctgttgatgcctgcggagccccggctccccagagctccggcccgcccccgcagcaaccgccagcacgactgacatccgtcgaggtaacccccacgatgaacagcacgaacagcgccacccctgccgctcccgtcgctcccgccacggtcgagagcgacctccagatcgccggcgacatcctcgccgtccagcacctcctccagcccgcccgtgaacacccggccaccgtcgccgagttcgccgggctcgcccgttccatcgccgaggaccgcgcctcctgggaacacctcgtccggtacgacgccaccacccgctggtaccaccggctgcgcaccggccccgggtacgaggtgtggctgctcagctgggtccccggccagggcagcggcctccacgaccacggcgcctcctccggcgtcatgaccgtcctggagggcgagctcaccgagcacaccccccgcggccgcaacacccaccgccccggcacccagcgcgtcctcgcccccggctacgcccacgaggtcgtcaacgacaccctcgacggcgcggtcagcctgcacgtctacttcccgggcctgaccgagatgccgatgcacagctgctccccggccgaatccgcgtccgtccccgcctgacctccgccccccggcggcggtgcggctgacagactgtccgcatgcgcattgttgttctggccggcggtataggcggcgcccggttcctgtccggactcaagtcggccgtgcccgacgcggacatcacggtcatcggcaacaccggtgacgacattcacctcttcgggctcaaggtctgccccgacctggacacggtgatgtacaccctcggcggtggcatcaacgaggaccagggctggggccgcaccgacgagtccttcaccgtcaaggaggaactcgccgcgtacggggtcgggcccacctggttcggcctcggcgaccgcgacttcgccacccacatcgtgcgtacgcagatgctcggcgcgggctatccgctgagcgccgtcaccgaggccctctgcgaccgctggcagcccggcgtacggctgctgcccatgtccgacgaccgggtcgagacccacgtcgcgatcaccgaggcgggcaccggtgagcgccgcgtcgtccacttccaggagtactgggtccggctgcgcgcctcggtggacgcggaggcggtcgtccccgtgggcgccgagcaggccaagcccgcccccggcgtgctggaggccatcgccgccgccgacgtgatcatcttcccgccgtccaaccccgtggtctcggtcggcacgatcctcgccgttcccggcatccgggacgccgtggcctccgccggggcgcccgtcgtgggcctgtcccccatcgtcgggggcgcgcccgtgcgcgggatggccgacaaggtgctggccgcggtgggcgtcgagtccaccgccgccgctgtcgccctgcactacgggaccgggctgctggacggctggctcgtggacacctccgacgcggacgccgtcgcggaggtcgaggccgccgggatcacctgccgcgcggtgccgctgatgatgaccgacgtggaggcgaccgcggagatggcccgcgccgcgctggaactggcggaggcctcccggtgacgccggtgcccgcgtacgaggtgcgggccgtcgacgggatccccgaggtcaggccgggcgacgacctggcgaagctgatcacggcggccgcccccgacctgcgcgacggagacgtcctgctggtcacctcgaagatcgtctccaaggccgagggccggatcgtggaggccgactcgcgcgaggccgcgatcgacgcggagaccgtacgggtggtcgcgcgccggggtccgctgcggatcgtcgagaaccggcagggcctggtgatggccgcggccggcgtggacgcctccaacaccgcccccggcacggtgctgctgctgcccgaggacccggacggctccgccgccgcgatccgcgccggggtgcgcgacaccctgtccgtggacgtgggcgtggtcgtgacggacaccttcgggcggccgtggcgcaccggactgacggacgtggcgatcggctcggccggcgtacgggtcctggacgacctgcgcggcggcacggacgcgcacggcaatccgctgagcgcgacggtggtggcgaccgcggacgagctggccgccgccggtgacctggtcaaggggaaggccgccgggctgccggtggccgtcgtgcgcgggctggcccacctgctgggcgagggttccaccgcccgggacctggtgcgcccgtcggccgacgacatgttccggctgggcacctcggaggcggtacgggaggccgtgacgcagcgccgtacggtgcgggccttcacgccggagccggtggacccgggagcggtccggcgggcggtggcggcggccgtgacggccccggccccgcaccacacgacgccgtggcggttcgtgctgctggagtccgaggcctcacgggtgcggctgctggacgcgatgcgggacgcgtggatcgcggacctgcgggcggacggcaagtccgaggagtccgtcgcgaagcgggtgcggcgcggggacgtgctgcgggccgccccctacctggtggtgccgtgtctggtgacggacggcgcgcaccactacgggcacgcccgccgggacacggcggagcgggagatgttcgtggtcgcgatgggtgcgggcgtgcagaacctgctggtcgcgctggccggggagcggctggggtcggcgtgggtgtcctcgacgatgttctgccgggacgtggtgcgggaggtgctggagctgccgcaggactgggacccgatgggaacggtggcggtggggcatccggcggcggctccggcggagcggccggggcggtccgcggcggagttcatcgaggtccgctgaggcgacccgggccgtgtctcacggctcagaggcggccgatgtcgccgcgcggcatccggggcgcgcggcggggcggggtgcggcccgccaggaggatgaggcgggccgcgcggtggcgctggccggcgtacggggcgaggagctccagcatggctgcgtcgtcggcgtcgcggtcgcccgcgagggcgtagccgacgatgccgggcaggtggaggtcgccggtggtgatcgcgtcggggtcgccgttgctgcgctggagggtctcggcggaggtccacgggccgatgccggggacggcctccagccttcgtacggcctcgggcaggtccatcgcggccgcctcctccaggcggttcgccacgcgggcggcgcgcacgatcgtggcggagcgcttggcgtcgaccccggccttgtgccagtcccaggacgggatcatggcccaggtgcgcggcgcgggcatgacgtacagctccgggccggccgggccgggggccggctcgccgtactgccggaccaggcggcgccaggcccggtaggcctcgtcggcggtgaccttctgctccaggatcgtggggatcagggattcgaggaccaggccggtgcgggtgaggcgcaggccgggacgccggcggtggctggcgtgcacgaggcggtggcggggcacgaaggcggcgggatcgtcacccgcgccgaggagcatgggcagctgttcgaggaaccagccggcgccggggccccaggcctcggcgtgcacctgctcgcccgcgcgggacacgcggagggtggccgggccctgcggggtgtgggcggtacgccagacggagccgtcgggggtggtgcggaaggtggggtcgccggggccgcggcggagcgggccgagggtgagcccgaggtcgacggggccgccgggggtccagcggcgctcctcggcgccggagccggcggtgctgccccggcccgtgggtacgtcggtgcggccgccgcggaccgcggcacgggtgaggggatcgaagcggccggccatgccccgagcgtagccctgcccggccgcgtctcccccggggctccgccccggaccccgctcctcgaacgccggcggggctggattcggcccagccccgacgacggcgccgcacgccacgggccccgcgaaccgcaggaggctacgggcggccctggagcttggccgaggccttgcgggtggcgcccagcttgccgtagagcttcgcgcccgggcattgggtggcgaagccgtcgcggtggccggagatgacgttcatcgacacggccctgcccttggggtagaggttgcctccgcccgacgtcagggtggtcttcgcgcgcgggtcccggccgaacaggccgagcttccaggccgtgaggcgggcgacggcgtcgaccgccaccgcgggcgggggcgaggaggtgaaggtgcccagcaccgcgacgcccatgctgttggtgttgaagcccatggtgtgcgcgccgaggaccggcttggagacgccgcccgcgcggccctcgtagaccgtgccgcacttgtcgacggcgaagttgtagccgaagtcccgccagccgctgctgatcacgtggtagcggtacaggctgcgcaggacggcgggggcgtccttgcaggcgtagttgttgccggaggcgctgtggtggacgaaggccgccttgaccgtgctcgtgtagacgaagcccggctcgcgcaggccctcgtcggcgccccagcccttgcgggtgacgatccgcgggcgcgggccgatgtacggggcggccgccgcggacagctcgccgtcgctcgcgaagaccgcgtcggcggtggagtcggccttgtcgagcgcggtgatctcgttggcgccgagcgaggcgtgcgggacgttcgcggcggaggactccgccgtcgccatcgacatggcgggcaccacctcgcccttgccgtcaccgtccgggccggtgttcttgccgtcggtccccccggcgggggtttccgcgcccgggtcgacgagctcgatccgcatgccgctgggcagccgggagggggcgcgggtggccggggcgccggactcggcctggacgcggacctccactccgtcggactcgcccacccacagcggggcggtggcgccgcggatcgggcgggagccgcgttccgctgcgtcggggtcggcggcgtgctcgccgttgtgggtctcgacgtcctgccagtccgaccaggtggcggtgcgggtggagcgggtgcgcacctggacccggccgttcagttcggtggccgcgtcgtcccagaccacgccgaccagcgagaacgtcttgacctcgcgtgcggtcaggccctgcgtctcggggcggcccggggaggcgctcattccggggactccgggcgcccgcgtcgccgggggtccgagcgggaccagcggcagcgactgggtggacccggcgggggttacgggggcggtctcggccagggcgggggtggggagcgcgaggggcagggccagtacggcggccgtcgcgacgccgatcgaggaagcaaggaatccacgcatgaaaaggatggtgagcacgtcgaccgccgggcgccatccgagaactgacgctccgtccgacgcgccgtgcgtaccgctcccccgtacggtggagccgacggcccccgtacgggggacgggcccgcgtacgctgtgccgggtgaacgccactgaccgcacccctgccgacctgctgcgatccgcgctcgccgccgatccgggccgcccgctcgtcaccttctacgacgatgccaccggcgagcgcgtcgaattgtccgtcgcgaccttcgccaattgggtggccaagaccgccaatctgctccagggcgacctgggggccgagcccggggaccggctcgcgctgatgctcccggcgcactggcagagcgcggtgtggctgctcgcctgcgcctccgtcggcgtcgtcgccgaggtcggcggcgacccggccgccgcggatctggtcgtcagcgggccggacaccctggagcaggccctcgcgtgcggcggtgagcgggtggcgctggcgctgcggccgctgggcggccggttcccgcagccgccggccgggttcgccgactacgcggtggaggtgccggggcagggcgaccgcttcgcgcccttcgttccggtggatcccgagggtccggcgctggtcgtgggcggcgaggagctcacgtacacggcgctcgtggcccgcgcccgcgaggacgcggcgaagctcgggctcggcgagggctcgcgggtgctgaccgggctcggctacgacacctgggacgggctctcggccgggctctacgccgcgctggccgcgggcgggtccgtggtgctgtgccggaacctggaccggctcccggcggacgggctggcgcagcgcagcgagagcgagcgcgtcacccacaccgtctgaaccgcctgaaccgtctgatcgccgccctgaggcctgtcccccacactggtgacaggcgagtacgggcgatttgtcacccggacggccctagacaggcccccgcccccgggctgctccggcgccccgggggcagcatcggcagtggccgtgctcacccgtacggccgacggcccagagtcgtagcggcgaggggacggacgccagtgacggacagcgcaggcacaccgggcggcaccgaagcggccgggggcgcgggacggaccccgcgcggccgcgggcgccggcgccggctgctgcgctggatcggcctgggggcggtcttcctggtcctggcgggtacggccaccggctggtggatctacaacaagctcgacgggaacatcaccgaggacacctcggccgcggccgagctgaggcgctacgagcgcgagcgcccggcgcacctggccaccggggcccagaacatcctgctgatcggctcggactcgcgttccggcaagcgcaacgccggatacgggcaggacgggggcacccagcgctccgacaccacgatcctgctgcacctgccgcaggaccgcaggagcgcgaccgcggtgtcgatcccccgggacctgatgacggacgtccccacctgccggaaggcggacgggacccgtaccgccgagcggttcgcgcagttcaactgggcgttccagtggggtggggccgcctgcacgatccgtacggtggagaagctcaccgggatccgcgtcgaccaccacatggtggtcgacttcggcgggttcaagaagatggtcgacgccatcggcggggtggaggtctgcctcaaggagccggtgaacgacgccgaggccaagctgcggctggccgccgggcgccagaccctgcggggcgagcaggcgctggggtacgtccgtgcccgccacagcctgggcaacggcagtgacaccgaacggatggaccggcagcagcagttcctcggatcgctcgtcaagaaggtgcagagcaacggggtgctgctgaatccgacgcggctgtacccgctgctggacgcggcgacctcctcggtgaccacggacccggggctggcctcgctgcgcggcctgtacgaactcgtgcgcagcatgcgggacataccgaccgagcaggtcaagttcctgacggtgccccgcaagccgtacgcgcccgaccctaaccgggacgagctggtcgagcccgacgcgcagcggctgttccagcagctgcggatggacaagccggtcacggtcgcaccgccggaacccacgccgaccgcgcctgcggcggaggcgcggggggagggcaccggggccggttcggacgcggatcccaccggcgagggaaccatcacacctcaggtacccgtccctactttcaccggaaccactgcgggtaacgccgactgccggtaaagcaatctcaaaagccggtgaccgaaccgagtgggatgggcgattcaccccgttataaggggagtggaatttgtcaccagcatggtttgccgccgaacagggcggatagggtgagcgatccggtgcccggccgaaccagaagcgggcaccagcagccggatcgttgaccgtgcgcccgggggaggcgcgtcgcgaggcaccgacggaggattcgagcaaccgtggatgcgcaaagccgtgggcgggccgacgagatcgaccccgcagaccagtgggtactcaatccccgcaccggcaactacgaactgcgactggccgactccgccgcgcaagcgcggcccaaggtcaccgcaccccgcagatcaccgtctgctccttcagcccccacctcgccctcccctggcgtgccgaggccgcggcgcggcgaccccccgcccggcggcggccggcgcggcggacgctcccgcaagctgggcggcggaggccgcaagaaggcgctggccatcaccggcggcgtgctggccttcctgctcgtcggcggcgccgtggccgggtacctctactacgaccacctgaacggcaacctcagcgtcaccgacgtggcgggcgcgggcacgggcggcttcaagaaggaccaggccatcaacatcctggtcatcggtaccgacaagcgcacgggcgcgggcaacgagaactacggcgacaaggacagcgtcggccacgccgacaccacgatcctgttccacgtctcgaaggaccggacgaacgcgaccgcgctgtccatcccgcgcgacctgatcacgaacatcccggcctgcccgacgaagcagccggacggatcgacgaagacgatcgcccccagcaagggcacccgcttcaacaccagcctgggccaggagggccgggacgcgggctgcacgatgcgaacggtcaaggaactcaccggcatcgaggtcgaccacttcatgatggccgacttcaacgccgtcaagacgctgagcacggcggtcggcggagtaccggtgtgcctggacaaggccgtcaacgacgaggagggctcgcatctcaagctggacgccggtgaacaccggctgcagggtgaggaggccctcgccttcgtccgtacccggcacggcttcggcaacaacagcgacctcgaccggatccggatccagcagcagttcctgggttcgatgatgcgtgagatgaagtcgaaggagacgctgaccagccccaagaagttcctctccctggcggaggccgccaccaagtcgctgggggtggactcggggatcgggtccatcggcaaactcaccgatctggcaggcgagttgaagggcatcgacacgaagaacatcaccttcaccacgctcccggtgctcgacaacccggccgagccggagggcaagaaggcgaccgtcgtcgtcgatcaggccctggccgatccgctgctgcagatgatccggggggacgtctcgctcacggaggtcgagaagaaggagcaggccgccaaggaggcggccgacgcggacgcgaaggccaagcaggacgctctgctccagggcacccgcgcggccgcggcggacgtacgggtgagcatctacaacggcggtggccccaagggcgccgcctccaccacggtgaactggctgcagaacagcaagggcgtggccaagtccagcaacgtcggcaacgcgccctccaaggtcggcgccacgcagctggagtacgcgcccaaccaggccgaccaggcccgggcgctggcggacatcatgggcctgcccgcgaccgcgctgaaggcggggacggcggacgccgcggcgaagaccccgatgaagctgacgctgggtccggacttccagcagccgggcgccccgctcgcggcctcggcgccgcagtcgctgcccgaggacgtgcagcgggcgcaggccgacaaggccgtctgcgccaagtgacgggaccctgccggtgacaccggcactctgttgaccaagaaggatcttgagggggacgtgtgaggcacagcagcgtgcgaggggagggggcgaacgcccaggccgccggggagatatccggcggcgtggcgggcgcctccggcacggtgcccccccagcggggcggctccggagcggctcgacgggcggccggcggccctccccgcagacagggccggcggcgcgtactgcgctggaccgcctccgtactgtccctgctgatactcgggaccgcggcggctggatacctgtactaccgccacctgaacggcagcatccagacggacgcgctgaacctcggcgagaccaaactgggcggctccaagcccaacgccttcgggcagacccccctgaacatcctgctgatcggctccgacgcgcgcgacgacgcggcgaaccaggcgctcggcggggccacggacaccttcgacggcccgccgctggcggacgtgcagatgctgctgcacctgtcggcggaccgcagcaacatgtcggtcgtctcgatgccgcgcgacacgatgctgatgatgcccaagtgcaccgagccgggcggcaaggtgcaccccgccagcaagggcctcgtacagaccaacgagtccctgcagcgcggcggtccgggctgcacggtcgccacctggcaggaactgacccagatcccgatcgatcacttcatgatgatcgacttcaagggtgtggtctcgatggcggacgccatcggcggcgtcccggtctgcgtcgaggagaacgtccactcccgcacgcgtgacggcaagggctccggcctgaagctgccgaaggggacgagcgtcatccagggcgagaccgccctgcagtggctgcgcacccgctacggcttcgaggacggcaccgacatcggccgcacccacgcccagcaccagtacatgacgtcgatgtcccgcgagttccgcaagaacgccaagctcaccaacccggtgaagctcaacagcctggcgcaggcggcgatcgaggccatggtcgtggaccccggcctgaacaagatcgacaagctgtacgacctgagcatggagctcaagaaggtgcccccgggccggatcaccatgaccaccatgccgtgggtctacagcaccaagccgggcctcgacggccgggtcgagcccatggcgggcgaggccgaggccgtgttccggatggtccgcgaggacatcgcgctcgacggcaagggctccgggaccccggagagcggtgcctctccctcgccgggcgtctccgcggccccggcgagccccaccgccccgaccccgccggcttccaccacggctccggccgcggcccccgcgaagatcccggtcagcgtccgcaacgccacgagcggcaaggacggcgccgagacccgggtcaagaaccgggcgaacgacgtggccgccctgctgagcggcaagggcttcaccaaggcttccgccgacacccagacgggcgcggaggacaccacggtggtccgctacgccacggacgcccaggcggccgacgcgggcgccgtggccaccgccctgggcctgcccgccgcctcggtgcagaagtccggagaggtccccgggatcaccctgttcgtcggcaaggactggcgcagcggcagcgcgccgaccccgccgccgcccgccccgaccgtggccccgacctcggcccacgcgctcaacggcgacaacgagggcgcctgcatggcgatccagccgggcttcacctggtaggacgcacgcgaaaggggcccggtgcggcggctgcgaggactcgcggccgccctaccgggccccttcgtacgtctcagacctgcgaggagtcccggcgcacggccggacggcggctcgcgatgaccttgttcgccagctcccgcgggctggtcaggaagccgaagccccagcacaggtgcatggtcgccagggcgacggggatctgcgcccgggccttgagaccgagccccttgcccgccggtacggagcccgcggcgatcgccgcgaggtagccggccgggacggcgaagcccacgggggtgacggccacgcccacgaccacgcccgcggcgagggcgcagacgagggtcggcggggccaggtagcgcaggttgatggagcccgagtggtagcgggccacgacgtgccgccagcgcccgtagtccttgtactgcttggccagggcccgtacggagcgccgcggacggtactggaccatcagctccggcgagaaccagatcagaccgccggcttcacggatgcggaagttcagctcccagtcctgggcgcggatgaactcctcgttgtagccgccctgctgttccagcgcctcgcggcggaagactccgaggtagacggtctcggccggtcccgcctggccgccggtgtggaacggcgcgttgcccacaccgatcttcgaggtcatcgcggcggcgacggcctcttcccaggcgttctcgccctccgcgtgcatgatgccgccgacgttctgcgcaccggtctcctccaggaggcggacggcggtggcgatgtagttcggcgagagcatgccgtggccgtcgacgcgtaccacgatcgggtgacgcgaggccttgatggcggcgttgagcgccgccggggtccggccggtggggttcgggacggtgtggactcggggatcctcggcgacgagttcggcggcgatctcgtcggtgcggtccgtggacggcccgagtgcgatcaccacctccatctcacccgcgtactcctgttccaggatgtggcggatggaatcgcggaggtagtgctcctcattgagcaccggcatgatcaccgagactgcgggctgctgggcgggcatgtggtccttcaaggtcgggtatcggtgtcacgttaccgcgtacgggggaaccgggtgcgcgccgagcgatcggtacggacaactgctgatcgtatgggcctactgttctgccgaatcagccgatccggacagtgccccgaccgatcttcccgctgcccccgcggaggtgtccaccgtgccccagccgcaccgtcccgcccgccccgacgggccgccccgaccgcagcgcgcccgacgcggcggaggcggcggtcgcgcccggcaccgggacggacggccccggtggggggtacggatcgcggccgggctctcggtggcggtgctcggctccggggccgtcggacacgccgtgatgaccggcctggacaccgggatcgagcgggtggacccgttcaaggacatgaagaaccgcccgcaggccggacacggcctcaacttcctgctggtgggcaccgacgggcgggagaaggtctccccggaggagaagcgcgagtaccgcctgggcggggcgccctgccactgcacggacacgatcatgctggtgcacctgtcggccgacaaggagcgggccagtgtggtcagcctgccccgcgacagctacgccgaggtgcccgcgcaccgggacctggtcaccggcaaggcgcacaacgcccaccccgtacggctgaacgcggcgtacgcggagggcgggcccaacctgaccgtgcggaccgtggagaacatgacccgggtgaagatcgaccactacctggaggtcgacttcaccagcttcatgaaaacggtcgacgcgatgggcggcgtggagatctgcacggccaagaccatgcgcgaccggaacaccggcctcgacctgctgcccggcagccaccgcctcagcggcggacaggccctgcagtacgtgcgctcgcgccatgtcgacggggcctccgacctcggccggatgcagcgccagcagcggttcatcgccgccctgatcaagcaggcgaccgggggcggggtactgctgaacccggtgaagttcaaggaggtcagctccaccctcctcggctccgtccgggccgacagggacttcggctcggagcagatgctggccctcggacaggcgatgcgggacttcaccccgtcctcctcggagttcgcgtcggtgcccatcggcagcccctccttccccgtcaagggcatcgggtccaccgtgaagtgggacgagccgaaggcggccaagctgttcgaggcgctgcgcgaggaccggcccctggccccggcacggccggggaaggccggcgacggtccgcccgcggcggtgcccgtggacgtgcccccgacccaggtccgggtccaggtggagaacggcacccggatcgacggcctgggcgggcgggtcgacgccgcgctgcgcgccaccggcttcgacaccacccgggccccgggcaacggggccagccgcgaggtcaagcggacggtgatcacctacgacccccgctgggaccgctccgcccggtcggtggcggccgcgctgccgggcagcgagctgcgggcggtggcgggccagggccggacggtgctggtggtcgcgggagcggactaccgcaaggtggtgccggtgcgggccgaggacccgtaccaggggaccttcggggtggtcaccggcgaccaggtggtctgcgggaagtgaggagccgggcgggcgtcagtcgtcgaagccctgggccgcccgctcctcgcgcagcgccatgatcgcctggcggcgggcgagccggtgggtgcggcggatctgggcctcctggtagcgccgctcgtcctgttccgtctccgggaggacgggcgggacctcgcggggcttgccgtcggcgtcgaccgcggcgaagacgaggtaggcggtgccgacctgggtggcgggggtggactcgttccaccgctccgcgaggacgcgtacgccgatctccatggaggagcggccggtccagttgcactgggccttcacgtggacgaggtcacccacgcgcacgggtgcgaggaaggccatctcgtccatggaggcggtgacggccgggccgccggagtggcggccggccacggcgccggccgcgtcgtccaccagcttcatgatcactccgccgtgcaccgtaccgaggaggttggtgtcgttggcggtcatgatgtggctgagggtcgtccgggaggctgcggtcggcttcccgggcaggtcgcccggtatctgtgtcatacggacaccttaggggtgtcctggcggccgggccggatcagggagcaccgcgggccccgcccgaccggcgggacaccccgagatgggatgggtaggcatcagctctgcaacagcagcggtacggaatgcggaccgggctgtcggagcacgcatccgggcaggcattctagggcgcatgaatgactggccagaaggtcgtgacgacgcgtacgggcgcggcagcgcgcagccgcagcccgagggtgtgcagcggatgcggcacatccagcggcagcctcagcagcagccgctgcccgggcagcccccgcgcccgcagcgcccggcgggcccgccgcccgcgcacggcgtacccccgcagcaggcgggcggccacgacacgtacggcggttacgacagcggctacaacaccggccaggtctacggggcgcccgcgggcggtgccccgggcgggcccggtgggccgtccggacccggccgccccgggcgggcgcccggtccggccccggactggcgcaagcggatcaaggtcggctcgatcgtgctggtctccgcgctccttgtgacatccgtcgccacctacttctgggccgactccaaggtgcgccgcgaggtggacctctccaaggtcatcgagcgcccgaaggagggcgactgcacgacgtacctcatcgtgggctccgacagccgcgagggcatgtccgccgaggagaagaagaagctgcacaccggctcggccgagggcaagcggaccgactcgatgatgatcctggccaagtgctccagcgggaacaccatgatctcgctgccccgcgactcggacgtggagatcccgtccttcgtgggctcgcagtccggcaagaccttccccgcccagggccgccgggtcaagctgaacgccgcctacgcggaggacggccccgagctgctcgtgcggacggtggagcacaacacgggcctgcgcatcgaccactacgcggagatcggcttcgccggcttcgcgaacatcgtggacgcgctgggcggtgtggagctggacatcgaggagggcttcaaggacgagaagtcgggcgccgacttcaaggccggcaagcagaccctcaacggcgagcagtccctggccttcgtacggacccggtacgccttcgccgagtccgacctgcagcggacgaagaaccagcagaagttcctgtcggcgctggccagtcaggccgcgacgccgtcgacgatcctcaacccgttctcgctctacccgatgctgggcgcgggcctggacaccctgatcgtggacaaggacatgggcctgtacgacatgggtcagatgttcttcgcgatgaagggcgtcaacggcggtgacggtgtgtcgatgaacatgccgatctccggccagcgcggcggcaacctcgtctgggacaaggcgaaggtgcagcagctggtgaagcagatccagaacgacgagaaggtcaccgtccgcggtaactgacgcggtgagggagcgcggcccgtcggccgtactccctcccccggtcaggcgtccggggagaagcggatcgcggcggcgggcagccgcgcctcgcaccacacgcgggcgccgccgcgcagttcgttgtcggcccccacgtcggcgccgtcgccgatgacggcggcgtcgaggacggtccgcgcacccaccgaggcgcgggcgccgatcaggctggcgttcacctgggcgtccgggccgatgacggcgtcgtcgaggacgatggagccctggacgaccgctccggccccgatccgggcgccggcgcccacgacggtgcccccggagagcttggccccggtcgccacctcggcgcccggcaggaccaggtactcgccgcggcgtccggggacggccggggaggagaccacgccgcgtacgaggtcggcggaggcctggatgatcgactcgggcttgccgaggtccatccagtaggtgttctcggtgacgccgtgcagcttggccccggtggcgaggaggccggggaaggtctcgcgctcgacggagaccgggcggccggccgggatggagtcgatcacgctgcggcggaagacgtagcagccggcgttgatctggtcggtgatgatctcctcgggggtctgcggcttctcggtgaaggccagcacccgcccctcggagtcggtggggaccagaccgaaggcgcgcgggtcctcgacccggaccaggtgcagggagacgtccgcgtcggccgccttgtgggactcgaccagcccggcgatgtcgaggccggtgaggatgtcgccgttgaagacgaggacggaggagtccgggccgccggtcaggcgcgccccggcgttgcggatggcgccgccggtcccgaggggctcgtcctccaccacgtattcgaggctgaggccgaagtcggatccgtcgccgaagtagggctcgaagacctcggcgaggtagcaggtggccatcacgatgtgcgtgacaccggcggcggcggccctggctatctggtgggcgaggaacgggacgccggccgtggggaccatcggcttgggcgtgttcaccgtcacgggccgcaggcgcgtcccctgtccgccgaccagcaggatcgcttccgtcattgcgttctccccaaccgattccggcgtacgaaggtccaaatttagcccatcccgggggcgtcccaaggccggagccggatgggggtgaccgggtgcgctcccctgggggcgccacactcggcgtgtcatgaaatgaccggtgtcgaccggttcgttcaaccgtcaggcggtgaacggattgacgtggccgggcagttgctgtccgggccgcacgaagcgctgcctgccggtctcgtcccggaccgggacgaacccggcgtcggtcagccgccgggcgatccgctgcctgcggaccgtgcccagcctgaaggcgccccacaggaacgccgcgagcgccgcgccgccgaccagcgcgccgatcggcatcccggcgaggagcaggacgagcgccaggaccgcgcaggatccgtaggcgaacgtctgctgccgcctgtccgcggcctgggccaggacgtcgagcatgatccggtctttcagccgggccacggcctcctcggcttcgggggtcggcttgaccgtccccggccgcattcccggcaccgtcccgccgctgccggcctgcgggtgggcggcgatggtcgccgcttcgcgggcgcgtgccccggggtgcgggtcccggtacatccgcacgaggatctgcatgtcgttgtgcccggtccggtgggcccggtcgtacgcgtagccgtactgctccgcgacgtgggccagggcggcggcccggccggcggcctgctccggaccgatctcgacgacgtcctggcgggcgatctgcccgagcatcgccgatatctggcgttccgtgaacatgcttgcttccgccccacctgcgcgcctacggctgacagcggcacagcctagcccgccgtcccgggcgcggacgtcccccggcgggctgccgggggacgtccgcgtcggtgcgggtcggaccgggggttacggcaggttgcgggccatgacgatccgctggacctggttcgtgccctcgtagatctgggtgatcttggcgtcgcgcatcatgcgctcgaccgggtagtcacgggtgtagccgtagccgccgaggagctggacggcgtccgtggtgacctccatggccacgtcggaggcgaagcacttggccgcggcgccgaagaaggtcaggtcctccttgtcacctccggcggagacgcgctcggacttggccgcggccgagtaggtcagctggcgggcggcctcgatcttcatggccatgtccgcgagcatgaactgcacgccctggaagtcgccgatcggcttgccgaactgcttgcgctcctggacgtagcccttggcgtagtccagggcgccctgggcgatgccgagcgcctgggccgcgatggtgatgcgggtgtggtccagggtcttcatcgcggtggcgaagccggtgccctcggcgccgatcatgcggtcggcggggatccggacgttgtcgaggtagacctcgcgcgtcggggagcccttgatgccgagcttcttctccggggcgccgaaggagacaccctcgtcggacttctcgacgacgaaggcgctaatgcccttggagcgcttctcggggtcggtgacggccatgaccgtgtagtactcggagacgcccgcgttggtgatccagcgcttgacgccgttgagcacccagaagtccccgtcgcgcacggcgcgggtcttcatgccggcggcgtcggagcccgcgtccggctcggagagcgcgtacgagaacatcgcgtcgcccttggcgagggggcccaggtacttggccttgagctcctcggaaccggagaggatcaccgggagcgagccgagcttgttcacggccgggatgagggaggaggaggcgcagacacgggccacctcctcgatcacgatcacggtggcgagggcgtcggcgccggcgccgccgtaggtctcgggcacgtggacggcgtgcaggtcgctggagaccagggcgtccagggcctcctgcgggaagcgggactcctcgtcgaccgcggccgcgaacggcaggatcttcgcctcggcgagcgagcggaccgactcgcggagcatgtcgtgctcctcggccgggcggtacaggtcgaagtcggcagaacccgccaagatctctcactccccagggtgatgcgtgatgctaactaccgttaagtaacccaagcttagtggtccggtcacggatggcgatatggacggcccacgtgagatgggtgacagcggaggtctcctggggaacgtccccgctggtgggcccgactatgctcagtggccgcaaacggccccgcacctctggagcacccatggcccccctcaggatcactgtgatcggcaccggatacctcggtgcgacccacgccgccgcgatggcggagctgggattcgaggtgctgggactggacgtggtgcccgagaagatcgagatgctgtcctccggccgggtcccgatgtacgagcccgggctggaggaactgctggccaagcacgtggccggactgcccggcgccacggggcggctgcggttcacgacctcctacgaggaggtcggcgcgttcggcgacgtccacttcgtctgcgtgaacactccgcagaagcacggcgagtacgcctgcgacatgtcctacgtcgacgccgcgatggcctcgctggccccgcacctgacccggccggtcctggtcgtcggcaagtccacggtgccggtgggctcggcggagcggctcgcggtgaagctcgcggagctggccccggcgggcgcggacgtggagctggcctggaacccggaattcctgcgggagggcttcgcggtcgctgacaccctgcaccccgaccggatcgtgatcggcgtccagggcgagcgcggcgagaaggtgctgcgggaggtgtacgagacgccgatgtcggaggggaccccgctggtcgtcaccgacttcccgaccgcggaactggtgaagaccgctgccaactccttcctcgccaccaagatctccttcatcaacgccatggcggaggtgtgcgaggccgccggcggtgacgtggtcaagctggccgaggccatcggctacgacgagcggatcggcgcgaagttcctgcgcgccgggatcggcttcggcggtggctgcctgcccaaggacatccgggccttcatggcgcgcgccggcgagctcggcgccgaccaggcgctgaccttcctgcgcgaggtcgactccatcaacatgcggcgccgcgggcacatggtggagctggcccgggaggccgtgggcggttcgttcctcggcaagcgggtcgccgtgctcggcgccaccttcaagccggactcggacgacgtccgggactcccccgcgctgaacgtggccgggcagatccacctccagggcggccaggtcaccgtctacgaccccaagggcatggacaacgcccgccgcgtcttcccgacgctggggtacgcggactccgcgctcgcggcggcccggggcgcggaggtggtcctgcacctcaccgagtggcgcgagttccgcgacctcgaccccgccgagctcgccggggtcgtcaccgaccgcctcgtcctggacggccgcaacgcgctggatcccgtgcggtggcgtgccgcgggctggacgtaccgcgcgatgggccgcccccgcgcctagggggtgtcttgtcgatcagggtggatcagggagcggtggccggtgccgtggatcgcaaggcggacgagggaggcgacgcggagcgtcgccgaccgaggacaacgcggcgaggcgcggtgccggccgccgcgagcccggcctgatcggcaagacaccccctagccctccgggcgggcggggtgcggatccgggtgccggtgcggcgccgttgccggggcgccgccccggaccccgcgcctcacatgccggcggggctcgttcagcggcggtggccggcggcgcgggcggtgaattccgcgtcgcggaccacgcgctgggcgttgccccaggtcagcagggcgacctcggactccggccagccgcgctccagcagctccgcgatcagcctcggatagcccgaggggtccgtcaggcccgtcgggcgggggtggcccggtccggtgccgaaggtggcgccgagtccgacaccgtgcgggcccgcgatcgcccgtacgtggtccaggtggtccgccaccgcgtgcagggagtccccggtgcgcgcggtgtcgaaggtgaccatcgcgagaccgttcgcctcccggagcgcggccaggacctcgtcggtcacgttccccggatgcgggttcaacgaggccgccgccgtgttcgagatgatcaccggggccttggaggcacccgcgagccggcaggcgaccgccggtgcgcagcccgtcaggtccagcaggatcgccagccggttcgcctcgcggaccacctcgtggccgaaggccgtcagctcctcctgcgcccagggggcccccgcgggcgcgaggatccgtacgcccagcgcgtggaaggcgcgcagcgcgcccagggagccggtcagcgtgcggccgggcaccgggcccaggaacgaggcgatgcggccccggttgcgggcgtccgccaggtcgtcggcgctcagggccaggcacaggctgtcggggtagcggcgcatcagggtcagcgccgtgtcgatctggtcgagcgtgtcggagagcacctggtcaccgggggcgtcctcgtgcgccgacgggacgagcagggaccagaactgggccccgactcccccggcgcgcagtcgcgggatgtcggtgtccacgcccgtgtccgaggtctcgatgtcgtggtacgggctctggtgcagggtccggaccagggtgttgcacccgtcggccacgggatggacggccagcagcgcgacggcccggtcgagggcgcccgccgccaccgctgccgcgggtgcggggaggtcttcggctccgatgcccacggagtggggttcatcctgcaggtcggccatggcgttcgctccggtctcggcggcagcagggagaggtggtgccaccgtgacacgcgggacggccgggccgcccggcggacgcagcgttcgagtgaacccgcaggtcacaccctgtcaccgcccccgccgggccccgcgtccgctaccggatcaccgcgttcgacgggccccgggaggccgagaggtcgcgggcgaccgcctccgcgtcgcgcagcacccgtaccgcgttggaccaggtcagcttggccaggtcggccttggaccagccgcgcgcgagcagctcggcgacgaggttcgggtagcccgccacgtcgtccaggccggacggggtgaaggccgtgccgtcgtagtccccgccgatgccgatgtggtcgatgccggccacctcgcgcatgtgctccaggtggtcggccaccgtcgcggccgtggccaccgggcgcgggcgctccgcctcgaaggcccggtgcagggccatcgcctcgggggtggtgtccaggtggtggaaaccgtgcgcccgcaggttctcgtccgcggccagggtccactcgaccgccgccgggaggatgaacttcggtacgaaggtggccatcgccaccccgccgttgcccggcagcatggccagcacgtcgtcggggatgttgcgcgggtggtcgcagaccgcgcgcgccgaggagtgcgagaagaccaccggcgcggccgagaccgcgatcgcgtcccgcatcgtcgtcgcggcgacgtgcgagaggtccaccagcatgccgacgcggttcatctcgcggacgacctcgcggccgaagtcggtcagaccgccgtgccggggctcgtcggtcgccgagtccgcccagtcgatcgtgtcgttgtgcgtgagcgtcatgtaccgcacgcccagctggtgcagggcgcgcagggtggccagcgagttgttgatggagtggccgccctcggcacccatcagcgaggcgatccggccgtcggcgcgggccgcctccatgtcgtcggccgtcagcgcccgcacgaggtcgccggggtaacggtcgatcagctgggtgacgacgtcgatctgctccagggtggcgctgaccgcctcgtcaccggcgtagtcggaccgtacgtagacggaccagaactgcgcgccgaccccgccggcgcgcagccgggggatgtcggtgtgcaggtgggcggactggtcgcccgcgatgtcccgtcgcgccaggtcgtagcgcacctgctcgcgcagcgcccagggcaggtcgttgtggccgtccacgacggggtgggcggccagcagctcacgcgcctcttccaggcgctgcgccgcgctcacttcccgaacccgaaggactccgcgctcgcgaccttcgtacgcagccgcttgcccttctcggtggcctggtcgttgagctcctgctggaactcgcgcatccgggccagcagctcggtgtcgtgggcggccagcatccgtacggccagcaggcccgcgttgcgcgcgccggcgaccgagacggtggcgacgggcaccccggccggcatctggacgatcgacagcagcgagtccatgccgtcgaggtacttcagcggcaccggcacaccgatgaccggcagcggggtgaccgaggcgagcatgccgggcaggtgggcggcgccgcccgcacccgcgatgatcgccttcagcccgcggtcggcggcccgctccccgtactcgatcatctcgcgcggcatccggtgggcggacacgacgtcgacctcgtaggggatctcgaactcgtccagggcctgggcggccgcctccatgacgggccagtccgagtcggatcccatcacgatgccgatgacgggggctgcggaggtggtgctcatgcggtgaccgttcctctgaggtagtcggcagcgtggcgtgcgcgctccagcacatcgtccaggtcgtcgccgtaggtgttgacgtggccgaccttgcgaccgtgtttcacgtccttgccgtacatgtggatcttcagctgggggtcgtgggccatgcagtgcaggtacgccgcgtacatgtcggggtagtccccgcccagcacgttcgccatgaccgtccacttggcgcgggggcgcgggtcgcccagcgggaggtccaggaccgcccgtacgtggttggcgaactgggaggtcacggccccgtcctgggtccagtggccgctgttgtgcgggcgcatcgccagctcgttgaccaggatccggccgtcggtggtctcgaacagctccacggccaggtggccggtcacgccgagttccttggcgatgcgcagggcgagggcctgggcctcgcccgcgagggcctccgagaggtccggggcgggggcgatcaccgtgtcgcagaccccgtccacctggcgggactcgacgacgggataggccaccgcctggccgtgcggggagcggacgatgttcgccgcgagctcgcggacgaacgcgaccttctcctccgcgaggaccgggacgcccgccttgaacggggccgccgcgtcctcgggggtgcggacgaaccacacccccttgccgtcgtacccgccccgcacggtcttgaggatgacggggaacccgcccacctcgtccgcgaaggcggccacgtcgtccggatcgctcacgatccggtggcgggggctgggcgcgccgatctcgtcgagcttggcgcgcatcacccccttgtcctgggcatgcaccaaagcgtcgggccccgggcggacggggatgccgtccgcttccagggcccgcaggtgctccatgggtacatgctcgtggtcgaaggtgatcacgtcacaaccgcgcgcgaaggcacgcagcgtctccaggtcgcgatagtcgccgatgacgacatcgctcacgacctgggccgccgagtcctgcggggtgtcactgaggagcttgaatctgataccgagggggatacccgcctcgtgggtcatgcgggcgagctgaccgccgccgaccatgccgactaccgggaacgtcactcctccagggtatccgccggtattcggccaccgggacccgcatggacgcgcccccggccccggccgtccgtgtgccgtgcgtcgcacggtgccggaaggcacagacggagcgccggggggacacttagcatgggtgggttgacggagaacaccggacgccccgtaagcgggcggtgaccgacaggactgacctactgatgagcacgcctggcggagctgtcgtcgaacgcgtacgcggcctcgtgcgagaggtcgccaagttcggggcggtcggcggtctgggtgtcctggtcaacctgggtgtcttcaacctgatccgcaacaccaccgatctgcaggtggtgcgcgcgagcgtgatagccaccgtcgtggcgatcgccacgaactacatcggcttccgctacttcgcctaccgggaccgcgcgcagagcggccgtacccgtgagctgaccctgttcgccgcgttcagcggcatcggcctggtcatcgagagcggtgtgctctacgtcgccacctacgggttcggctgggacggcccggtcgccagcaacgtgttcaagttcgtcggcatcgggaccgccaccgtgttccggttctggtcgtaccggacgtgggtcttcaaggccctgcccgagccggccgaccgggccgagccgatgccggagccggcgcccctgccgaagccggaccgcaggccggagccgttgcccgagccggagcccgcgaacaactaggacgcccgggcagccgccccctagcggacggtggtctccggttcggcgcgttccggggccgtccggctgaggaacagggcgaacaccggcggctgcgtctggagcagctccaggcgtccgccgtccgcctccgcgaggtcgcgggccaccgcgaggccgatcccggtggagttgcggccgctgatggcccgctcgaagatccggttgccgaggtccggcgggacgcccggtccctcgtccgtgacctccagcaccgcctggttgccgatcacccgggtgcgcagcgcgaccgtgcccccgccgtgcatcagggcgttctccaccagggtggccagcacctgcgagaccgcgcccggggtgcccacggcccgcacgccctgccgtccggagcgcacgatggcccggcccgcgctgcggtaggccggccgccactcctcgacctgctgcttgacgacctcgtccaggtcgaaggggaccgccgagcccgtccgcgggtcccgtgagttcgtgagcagccgctgcaccacgtccgtgagccgctccacctgggtcagggcgatcgtcgcctcctcccggacggtcgccaggtcatcggtgaccgtgatctcctccagccgcatggagagcgcggtgagcggggtgcgcagctggtgggaggcgtccgcggccaggcgccgctcggccgtgagcatccggccgatccgctcggcgctggagtccagtacgtccgcgacccggtccagctcggggaccccgtaccgtttgtgccggggccgcgggtcgcccgatccgagccgctccgccgtctcggccaggtcggtcagcggggaggccagccggttggcctgccgtacggcgagcaggacggccgcgaccaccgccagcagggccaccgcgccgaccacggccagggtccgcccgacctcgcgggtcacggtggagcgggactcctcgacgaccacgacctcgccctgctccccgcgggcggtgccgcggatcacgctgtcggggatcggggcgcccacctggacggccggctggccggggacggtgatccgcgcgtagtggccggcgtccagctgctcgccgagggccacggggtcgatcggcttcttctccaggacgttcgcctcgacgctgcccacgagccgcagcgcctcggactcgatgcggtcctgggcgctgctggtgatggtccgggtctccacgatgacgagggagaccccgaagacggcgatcacgacgagcaccacggcgagcgtggagttgatgaggcggcggcgcatgccctagagcatgccccaggtggagccgggggaagtggtcagctcttctcgaagcggaaaccgacgccccgcacggtggcgatgtagcgggggttggcggcgtcgtcgcccagcttcttgcgcagccaggagatgtgcatgtcgagggtcttggtggaagaccaccaggtggtgtcccagacctcccgcatgagctggtcgcgggtgacgacgcggcccgcgtcgcggaccaggacccgcagcaggtcgaactccttggccgtgagctggagctcctcctcgcccatccaggcgcggtgcgactcgacgtcgatccgcacgccgtgggtggcggggggctggagggcctcggtggcgccgcgccggagcagggcccggacccgggcgaggagttcggccagccggaagggcttggtcacgtagtcgtcggcgccggcgtccaggccgacgaccgtgtcgacctcgtcggcccgggcggtgaggaccaggatcgggaagccgtggccctcggcgcgcagccggcgggcgacctccaggccgtccatgcccggcaggcccaggtcgaggacgacgaggtcgacgccgccctgcagtcccgcgtccagggcggtggggccgtcctcccggacctcgacctcgtacccctcccggcgcagggcgcgggccaggggttccgagatggatgcgtcgtcctcggcgagcagtacacgcgtcatgtgggtgatggtagtgcgcggcggctgaaaccaggggcccgcgggaagacccctctctatctgggcttatgaactactaagcgccttcgaatatggtcgaacggttcccggcgcgccttgtgatccatctctcaagtcctttcatatgcctcagtgtcgtgtcgtatggtggcgagacgcctgatgcaatacctcagggacctttgtgccgaaaagcagcacataggtctctatttctgtcctgaaccggatgggtggtcctatcgaggacttacccggccgtccttgacgacagtgaatgacctgttggccgggccccccgcgtgatgatgcgcgggcgggcgtggatcccggttgcggatgtcctgccgccccctcctgcggggcgggccccgaggcgtggggtgggagatccgccgccggtgccggccaccccccaccgggcgcggatgagctcacgaagccaagcgtcccgagcaagcaaggatcgaccatggcttccagcctgacgacggcctcaccgagccccgctcacgagaagaccgtcctcggccacccgatcggcctggccacgctgttcatgaccgagatgtgggagcgtttctcctactacggcatgcgtgcgcttctcgttctgtacctggtctccggcggcgtggacgccgcgaccggcagccagggcggtggcctcggcttcaccgcggcgacggccacggcgatctactccgtctacgtggccatggtctacctcatggccatgcccggcggctggttcggtgaccgcgtctggggcgcccgcaagacggtcgccatcgccggtgtcgtgatcatggcgggccacgtgtcgctcgcgctgcccggccagatcgcgttcttcgtcggtctgctgctggtcgcgatcggctccggtctgctgaaggccaacatctccacgatggtcggccacctgtaccgcggtgtggacgacccgcgccgtgacagcggcttcacgatcttctacatcggcatcaacgtgggtgccctcctcgcaccggtcggcatcggcatcgtcggcgagaccgtgaactggcacctcggcttcgcgctggccgccgtcggcatggccatcggcctcgtggtctacctgctcgccggccgcacgctgagcccgcagagcagcatcgtcccgaacccgctgagcgccgccgagcgcaagaccgtgatcgtcaaggcgctcgccgtcctggccgtcatcgccgtcttctacggtgccgtcgtcgccgcggacatgttcaccatcaagtgggcgctgtacccgatcaccatcgccggcctgctcatcccggtcgccgtcctcgtccgcatcaagcgggaccgggacctgtccaccgtcgagcagacccggatgagcgcctacatctggttcttcgtggccgccgccgtcttctggatgatctacgaccagggcggttcgacgctctcgctcttcggtgacaagaactccgagcgcagcctgttcggctgggaagtcccgaccaccatcttccagtcgctgaacccgctcttcgtggtggccctggccccggtcttcgccgccgcctgggtggccctggcccgccgcaaccgcgagcccagcaccatcgtgaagttctcggtggccctggtcatcgtcggcgcctcgttcttcgtcttcgccctgccgctgagccagacctccggcaacgacaccaaggtcaccatgtggtggctggtgctcatcttcctgatgcacacgctcgccgagctgtgcctctccccggtcggcctgtcggtcaccacgaagatggcgccgcagaagtacggctcccagatgatgggcgtctggttcctggccgtcaccgccggtgactgcatcaccggtctgatgggtctggccgacgtgcagctgaacggcgtcggggtcatcctcttccaggcggtcgccgccgtggccgccggtctcgcgatcttcatgtaccgcaagaaggtcaaccagctgatggacggcatgaactgacccgttcgctccccgtcccacggaacggcccggcacaccgcacggtgtgccgggccgttcgcgtgtcagcgggtgccgcgcaggcggcgccacggggtgaaggtgaacaccgccccgccgagcaggatcaccgtgccggcgaccagggccagggccttgatgccgccctcatcctccgcgccggtctcggccagaccgcccgaggtgccgctgccggaggcggtggtggaaccggagccgcccggctgggcggcggtgtccagttccagggagaccccgctgctcgtcgccttgcaggggacgttgatcggggtggcgccgggagccatcgtgacgtcgatcgtcagctggtccgggctcagcgtcaccttgccgctcttgccgggcttgtaggtgccggtcatgtcgctgaggctgaccggggccttgtccgggatcggctcggcgttggccgggccggagaccttgaccgtcccgctgtccgccccgccgagcttcacgtccatcgagggcttgagggctcccgcgggcagggccatgggcgccgccatcgcgcccttggcggtcttgaccgtcaggtcgtagctgccgccgttcttcttcgcgttgatcgtgaccggggtcttgatgccccccgggacgaccggcccgcagtcgaaggccacctcgaccgccttgcccgggaagtcggtctggccgccaccgccaccggaggaggaaccgcccgaggtggagccgccggtcgtcgagccacccgtcgtggagccgccggtcgtcgagccgcccgtggtggaaccgcccgtggtggagccgccggtcgtcgtaccgccgctggagccggccgccacgtcgatggtggcgcccacgcccacggtgccggtcggggcgcacttggtgacgaacgtgccgaaggagaaggtgaccgccacgtcgtacttgcccggggtcagcgtgatcttcccggccttggtgagcttcagcttgcccttcatcacggacatctgcatgggcgccttcttcgggatcggcgggttcttcttctccccgacgaccttcagctcaccgcccccgccgcccacggtgatccagccggtgggctggaccgcgtcctgcgggatgtccatcaggtccgtgttgttcgaggccggcttgaccgtctcccacgacacgtcgacctcgtcgccgaccttcgccgaggcgggagcggtgaccttggccgtggtctccccctccaccggcccgccgcccccggccgggggcacgcacttgacgttgaacttggtctccgcggcctgggcgggagtggctccgatggcgataccggcacccccgagcagcagcgcgatcacggccgcgctcaccctccgttgggtattcacgaatgtcccttcgtcgtcgaacggttctcagacggtgcggacgcctgtggtgctgtgcccggcgcgctgtccggggtgaaccacggcaggaccgccgtggtggtctggggggaccgctccgggcggtcggcgcccggggccggctcgggggtccgcagggccgggatcctcggcagccgggccgtcacggcggaggcggcggccgcggcggcctccaggggacccgtaccgcggtggcggccggcggaggccgccgcgcgcggccggacccggtcgacgacggccatgccgatacggaagaccgcggccgggatcaccagcaggagcaggccccagaagagcagcaccccgtacgggcggtccacgccccagggctgcgcggccagcacggtctcgccgtacttgagggagaccgtgtagtcgccgtgggcgccggcggccaggtccgcgtcgagggcgatctccgccttgccgccgggcgggatggtgcccttccagcgggcctcctcccacagcggggcgaacaccccgtgcgcggtgccgagctggaagaccgggtccttgaccgggaccgtgccgagattgccgacggtgaccttgaacttccgggcgggcggggctccgaaccaggtcagcaccccgtccccgccctcgagccggaccccggtgagcaccgcgaggcgggccgtgccggactcggcgggaagctcggcgaccgggtggtcggtgatcttcaggggcgccgcgacggtggactggtcgccgttgacggaggtgacgttgacgatgcaggggcagggcttgggcggtgccaccacgggcagctgggcggtgaagcccccgtcggcggcgaccgagacggcggcgccgtcggcgttggcgcagctgttggtgccgccgatcatgttctgtccgcagaccagcagcatcaccagggtcctggccggccacccggtgccggtgacggtgatcccggtgcccttggcggcctcctggagcgagagggccacggccggcttgccctcggcggcggccgggcccgcggggaacagggcgagggcgcacaccgccagccccgcggccagcagggctgcgactcttctcacctggcggctcccgtcagttcgtggtgcggtgcaggggtcgtcggtccggccgcgggcggcgcgtccggcgccgggcccgggcccggttcgggccgtcggccccgtacgaggtacagcgcggcggcggtcgcgccgaggccgagcagcccggccccgctccagccggccaggccccggggaaggagccagcacgatccggtggccaccgcgcgggcgccgccgggggccgtcacggtgagggtgacgcggacccggtcgagggccggggcgccgggccagggctcggtgagctccacccgctggccggggagcagttccaccggcagggtgcggccgcgcggcgggtcggacgcctcgccgaggagggcgtcggtgcggatccggagctcgggggccagggcgacgttgccgcggttgacgagggtgtaggcgatgacggcggccgcgccccggccccgtacggcgacgtcctcgacggtgagggcggccaaggcggggccgccgacccgcaggtggacccgtacgccgacctcgtggccgccgtcggtggcgagcacggcggcggggtggtcgcccggcggggacgcgggcggcacggtgagggtgaaggggaccacggcgcgggtgcggggcgggaccttcacggtcgtggccgccccgaagctgatccaggaccctgccccgggggccgtgggggcggcggcggtggcgccggccggccggaccgcgaaggcgccgtcggccgtgttgtaggcgtcggccccgcgcagcgtgatggtgcgctcctggtcggtggcgttggccagggcgaggcggtcctccagcacggtgccgggggcaccggccagatagaagtacgggcggacgccggacgccgttccggcggcgggctcggcggtccagcccggctcgtcggcggccgcggggtgcgccggggtcgcgtacgacgtggcggcggcgagcaggagggcgacggcggcgcgcctgagggcggggagcacgggcatgaccggggcgctccgttcaggaccgggcccgccggccgcgccgggtcagccagagcacgccggcggcgccggagagcagcacggtggcgccgagggtgccgaaggcgaggacggagtcggtggggccggtctgcgggagggtgtcgccggtggtgtcggcgccggaccgggtggtggtcccgccgccgggtgcggtgacgtccagttcgagcgagggccccgggctgttgccgggggtgcaggtggtcgtggtgcccatcgccttgatggtgagcaccccggcggtgaaggtgaccttgccgctcttcctgggcgtgtaggtgcccgagaggtcggtgatcttgatgggtgtgtcgggcggcacggcctcggggttggacgggccggagaccggtacggacaccttctctgcgccgtcgacgaggatgacggcgccggggctcatggcgcccttgccgagctcgatggggctggacgagacgcccttctggaaggacatcgtcagcttgtacccgtcgccctccttcacggccttgatgtcgatgggcgacaccgccgacttgtcgccgatcggggtcttgcagtcgtaggccacgtcgacgacggcggcgtgggccgcgggggcggtgaacagcaccgccgatccggccagcgcggaggccagcgcgagcgcggtggagcgtttgcggtcggacaccttcgtcttcccctcgggccacagaaaactgacgacacatcagatcggtggctcaaggtacgcccgggcccttacggagggaagacaaaggacaggcccgaatcgaccgttcgtcagcaggcgcggcggccccgctgccagacgccggaaacgagcggtacgcccggccggtaggccaggtggacatggctgggggcgtccagcagggcgaggtcggcgcgggctcccggggccacgacgccgatgtccgtacggcgcagggcgcgggcgccgccggcggtggccgcccagagcgcctcgtcgggggtcatccgcatgtcgcggacggcgagcgcgatgcagaacggcatggaactcgtgtaggaggagcccgggttgcagtcggtggacagggcgacggtggcacccgcgtcgatcaggcgccgggcgtcgggccactgggcgcgcgtggagaactcggcgccgggcagcagggtggcgaccgtggtgtccgccgcctgggcgagggcgtcgacgtcggcgtcggtgaggtgggtgcagtggtcggcggaggccgcctccagctcgacggcgagctggacgccgggcccgtaggagagctggttggcgtgcacgcgggggatcagcccggcggcggcgccggcggtgaggatcgcgcgggcctggtcgccgtcgaaggcgcccttctcgcagaagacgtccacccagcgggcgtacggggcgcaggccgccagcatctcgccggtgacgaggtcgacgtagcccgccgggtcctcggcgaagtcgggggagacgatgtgcgccccgaggtaggtgacttcctcggtgtgcgcggcggcgatgcgcagggcgcgggcctcgtcggcgacggtgaggccgtagccggacttggtctcgaaggtggtggtgccctggcggcgggcctcgtcgaggtggcggacgaggttcgcctccagctcggcgtcggtggcggcgcgggtggcggcgacggtggtacggataccgccggcggagtaggcgcggcccgacatccgggcgttgaactcctgggtgcggtcgccggcgaagacgaggtgcgagtgggagtcgacgaagccggggatgacggcccggccctgcgcgtcgaagacctcgtccgcggcgggcgccttggcggcggggccgacccaggcgaccttgtcgccgtcgatgacgacggcggcgtcctggacgaggccgagggggctgccgtcgcctgcggcggggtcgttggtgacgaggctgccgatgttggtgatggcggtggtggtcatggggttcctctcagagcaccgggctctgcccggacccggtcctcgaacgccggacgggctgacatacagcctcgccggcgcttgaggcgcggggtctggggcggagccccgggaaacggtcagccgcgcagggctgcgatggactcggacagggccgtcgggacgtccccgaccagggtgtggtggccgtcgcggacgatgtggcggccgccgaccaccgtgtggcggacgtccgaggcggtggcggcgaagaccgccgtctcggcgcccagcctcggcagcggacccgccgtgcgtacggagtccagggcgatcgtggtgaagtccgcgagcgcgcccgcctccaggcggcccgcgtccgggagcccgagagcggcgtggccgtcctcggtggcggcggcgagcagggcgttcgccgtccagtgaccccgggtgcggctgcgcaggcgctcgttcagctccatcgctcgggcctcttcgagcaggtcgacgacggcgtggctgtcgctgcccagggacagcgggctgcccgcccgctggagccgggtggccgggccgatgccgtccgcgaggtcgcgttcggtggtggggcacatgcaggtgccggtggtggtcccgccgaggagggcgatgtccgtgtcggtgaggtgcgtgttgtggacaccggtggtgcgcgggccgagcacgccgtggtcggccagcagctgggtcggggtgcgtccgtgggcggccaggcaggcgtcgttctcggcggtctgctccgagaggtggacgtgcaggggcgcccggcgctcctcggcccagcccgcgacggtggccagttcggcggcgggcaccgcgcggaccgagtggatcgcggcgccgatcagggcgtgcgcgcggggcttgagggcggcggcgcgctcggcccaggcctcggcggtgccgtcggagaagcgcagctggtgggcgttgggggcctcgccgaagcccgaggacaggtacgcggtgtccagcagggtgatccggatgccggccgcggcggcggcctcgatcagggcctcgcccatcgcgttcgggtcggcgtaggcggtgccgccgggcgcgtggtggacgtagtggaactcgccgacgttggtgatgccggccagcgccatctcggcgtacaccgcgcgggcgagggcgaagtagctgtcgggggtgaggttctgggcgaccttgtacatgaggtcgcgccaggtccagaaggtgccggagccgacctggaccgtgccccgcagggcccggtggaaggcgtggctgtgcgcgttggccagcccggggacggtgagaccgcgcagcacctcggcgccgggcggcgggctgcccacaccggtgcgcagggctccgatccggccctccgcggtgacctccagggcgacgcccggctcgacatgggtgccgagccaggcgtgctccagccagtacgtcgtcaacgacatgccaggccttccagtacgtcggcgagggcgaggacaccggcgacgcagtcgtcctcggcggcgaactcccgcggggagtgggagacgccggtcgggttccgaacgaacagcatggcggtcgggacggccgccgagaggatcccggcgtcgtgtcccgccccggtaccgagaacggggaccgaaccgcccaggatccggttcatctcgtcgcgcagggcgtgctcgaactcgacgaccggggtgaaggactcccggacgatgccgaggtcgatgccgtcctggtcggcgcgctcgcgggcggccttctcgatggccgtgacgaccgtgtcgagggtggcctggtcggcggcccgggagtcgagccagccgcgcacgagcgaggggatggcgttgaccccgttgggctcgaccgagatcttcccgaaggtggcgacggccccggcgaaggccgcctccgtgcgggcggccaggacggtcgccgcgtaggtgagcatcgggtcgcggcggtcgaccagccgggtggtgccggcgtggttggcctcgccgcggaagtcgaaccgccagcggccgtgcggccagatcgcggaggcgatgccgacccggtcgccggacaggtccagggcgcggccctgttccacgtgcagttcgacgaaggcgccgatccggcccaggcgttcggggtcggccccgatggcctcggggtcgtatccggcggcctccatggcctggggcagggagatgccctcggcgtcgcgcagctcgtaggccttgtccttggtcagctgtccggcggcgagccgggagccgacgcaggcgagcccgaagcgggcgccctcctcgtcaccgaagttggtgatggccagcggcctggagaactccgcgcccctgctgcggagctcgtccagggccgcgaaggaggacaccaccccgagggggccgtcgaaggccccgccgtcggggacggagtccaggtgcgagccggtgaccacggcgtcccccgcgagggggtcgccgagccaggcccactggttgccgttgcggtcggtctcgtacgtcagcccgcgcgcctcggcctgctcctggaaccaggtccggcagtcggcgtcggccccgctccaggcgtaccggcggtacccgccggtgccggcgtcgcggccgatgggcgcgagctgggcccacatctcgtggaaggtcacgcgtcgtcgccctcacgcatggggacgcggacgccgcgctcgtcggcgaccgactcggcgatgtcgtagccggcgtcgacgtggcggatgacgcccatgcccgggtcgttggtgaggacgcggcggatcttctcgccggccagcggggtgccgtcggcgaccgtgacctggcccgcgtggatcgagcggcccatgccgacgccgccgccgtggtggatggagacccaggaggcgccggaggcgacgttgaccatggcgttgagcagcggccagtcggcgatggcgtcggagccgtcgagcatggcctcggtctcgcggtacggggaggccaccgagccgcagtcgaggtggtcgcggccgatgaccagcggcgcggcgagggtgccgtccgccaccatctcgttgaagcgctcgccggccttgtcgcgctcgccgtagccgagccagcagatgcgcgcgggcaggccctggaagtggacgcgctcgccggccatcttgatccagcggtgcagggactcgttctccgggaagaggtccagcatggccttgtcggtcttgtggatgtccgaggcctggcccgagagcgccgcccagcggaaggggcccttgccctcgcagaacagcgggcggatgtaggcggggacgaagccggggaaggcgaaggcgcggtcgtagccggccagctgggcctcgccgcggatggagttgccgtagtcgaagacctcggagccggcgtccatgaagccgaccatggcctcgacgtgcttggccatcgactcgcgggcgcgggtggtgaagccggccgggtccttggccgcgtaggaggccatgtcgtcgaagtcgacgcccacgggcaggtacgacagcgggtcgtgcgccgaggtctggtcggtgacgatgtcgatcggggcgccttccgcgagcatctgcgggaggagctcggcggcgttgccgaggaggccgatggagagcggcttgcgggcgtcgcgcgcctcgacggccagctggagggcgtggcgcaggttgtcggccttgacgtccaggtagcggtgctcgatgcggcggtcgatggcgcgcgggtcgacgtcgatacagatcgcgacgccgtcgttcatcgtcacggccagcggctgggcgccgcccatgccgccgagaccggcggtgagggtgatggtgccggcgagggtgccgttgaacttcttcgcggcgacggcggcgaaggtctcgtaggtgccctggaggatgccctgggtgccgatgtagatccaggacccggcggtcatctggccgtacatggtcaggcccaggtgctccaggcggcggaactcctcccagttggcccagtcgccgacgaggttggagttggcgagcaggacgcgcggcgcccactcgtgggtctgcatcacgccgaccgggcggccggactggaccagcatcgtctcgtcctgcttgagggtctgcagggtgcggaccatcgcgtcgtacgagcgccagtcgcgggcggccttgccggtgccgccgtagacgacgagcttgtcggggtgctcggcgacctcggggtcgaggttgttctgcagcatccgcagggcggcctcctgctgccatcccagggtgctgagctcggtgcctcgcgcggcacgtacggggcggggtcctgacatggcggtgcctcctccgatgttggtcaatctattcacatcctcgcgccctgaatagattcagtcaacagctgcggtcggccctgtcggatgatgggatgggggccatggacacccagggtgccgccacgagcgcagccgagagttccgccgaggacgcggccgagcgccgtgacctggccgtacgggccgccgtcgagcaaggtctggtgggcggcagcgacaccgcggacccgctgacctgcctgctggacgtcgccgggatccgggcctccgccgccgccctcacctccgccttcgacggcgccgtcgcgcccggcacgcccgtcctgcacgccttcgccgtcaaggccgccccgctcgtcccggtcctgcggctgctcgccgacgccgggctcggctgcgaggtggccagccccggcgagctggcgctggcccgggcggcgggcgtccccgccggccggaccgtcctggactcccccgccaagacggtggccgagctgcgcgaagccctggccctgggcatcgccgtcaacgccgacaacccgcaggagctggaacgcctcgacgcgctcgtcggccgggcgccgaccgcgtccccgatcggcgtccggatcaacccgcagaccggtgggggcgccatcgacgcgctgtccacggcgacgtccacctcgaagttcggcgtcgccctgcgcgaccccggggcgcgcgcatggctcgtacgggcctacctggaccggccctggctcacccgcctgcacatccactcgggctcccagggcgttcccctggccctgatcgcggagggtgtacgggacctgcacgcgctcgccgaggagatcaacgcggcggccgggcagcgccgcgtcgacaccctcgacatcggcggcggcctgccggtgaacttcgcctcggacgagccggccccgacgtacgcgcagtacgtggccgccctgcgcgaggcggtccccgccctcttcgacggctcgtacggcctggtcacggagttcggccggtccctgctggccaagcacggcctggtgctggcccgtgtcgagtacaccaagaccagcggatcccggccgatcgcgctcacccacgccggggtccaggtggcgacccgcaccgcgtacgccccggcggcctggccggtgcggatcctgccgtacgacgcgaagggcgccccgaagaccggcgacccggtggcccaggacatcgccggccccgcctgcttcgccggggacctgctcgccaccgcccgcgagctgccccggctcgcccccggcgacctgatcggcgtcccggacaccggcgcgtacttcttcacggcccactacggctacaacagcctgccgcgcccggcggtccacggcttcacgctgaccgcgtcgggcgaggtccgcttccacctcgtccgcccggcgcaggacgtcccgtcgatcgtcgcggaggcgggcggcccgctgcgcgacgccctgcttccagcctcgccggcgtttgaggcgcggggctcggggcggagccccggtctttgagccgcaccggcgtcgagacccggggccggggccggggcccgggtcactccacgaacaggccccgcgcagcggcccgcgcgtcgaaggcctccagccgcgcctgcgcgtccggcagcgcgtccgccatcgactccagcagcacccggcccagcagcatcggcgcgcacgccgtgtcgaaggccagcccggtgccgacctgcgccggaatcagcaggtccgagtggcgggccaccggggcgaaggccgagtccgcgaccgtgaccacggtcaggccggcccgccgcgagcgttccagcgtgtccacgacctcccggggatgacggggcagcgcgaagcagagcagcgccgtggccccctcgtagcgggccgcgtcgatgcggtcctccatcatcgacccgccctcgtcgaggagccgtacgtccgggtgcaccttcgacgcgaagtacgcgaacccgcgcgcctgggacgaagccgcccgcagccccagcaccagcagcggggtcgaggcggcgagcagccggcccgcctcctggaccggcgcggggtcggcgagcatcgccgccagctgccgcaggttctcgatctcgcccaggacggcctgctggtactcgttgtacgagtcctcccgcgcgaccccgggccgctcggcgggggccacctcgcgcaggtggcggcgcagcgcgggatagccgtcgaagcccagggccacggcgaaccgggtcaccgacggctggctcaccccggccagttcggcgagctcgacgctcgacaggaagggcacctccgccgccccgcgcaccatgcagtgcgcgatccgccgctgggtcggcgtcagccggtgcccctcgaacagcttctgcagccgcgcggccgggctgtcgctcatcccgtcccctccgtccggtgagatattcagtcacggagcactctgcatgcggttatgcagcggggcaagccgtgcccgcgatccggatacgggggctagagcgtgtctctttgatgggttggtcagttgatcggatgtgtctgtccgattagtgatcactgatgcgatgtggggccggatcgagccgctgatgccggccgatccggtccgcggccggcggtgggccgaccaccgccgcacccttgaggccatcgcttggaagtaccgcacgagctcgccctggcgggacctgcccgacgagctcgggtcgttccagaccgctcacaaacgactgctcagatgggccgtcgacggcacttgggagaaaatcctcgcctccgtcctggcagcggcggacgccgacgacgacatcgactggaccgtgtcagtggactccacggtcgtccgggcccaccagcacgcggccggcgcacgcaaaagggggcggcccgctccggcgagccctccgatcacgcgctcggacgctcacgcggcgggctgagcaccaaggttcacctggccgcggacggtggggcacggccgctggcattcaccgtcaccgcaggccaggccggtgacgcacccgccttcgagacggtgatggcccgcatccgggtgccccgcacaggcacgggcaggccgcggacccgccccttcgtcgttctggccgaccgggcctactcctcccgagccatccgcagccacctgcgacgccggggcatccgcgcggtcatcccgcagccgtccgaccagatcggccaccgcctgcggcgaggccaccgaggcggccgcccgcctggctttgaccgagaggtctacaagcagcggaacacggtcgaacgctgcatcaaccggctcaagcagtggcgcggcctggccacacgaaccgacaagctcgccatcgcctaccaggccgcactccacctcgccggcatcctcatctggacccgacgctgaccaaagagacagaacctaaccccagtgccgggccccgccggggttcctacggtggggacatggacgcgcacgcccaagagctgaagaaggaattcgacgcgacgatggacgcccggcgcgagctgggtccggagtacgaggccgcgctcgtggactcgttcgtcgagaaggtcgacacccaggtccggcgccggctcgcggaggagcgcctggccgcggcccgcggtgagggccgtgcgcccgccgcggccccgggggacgggaacttcggcgaacgcttcgggttcgccgtcatcaccctggtgctggcgatcccgctgtcggcgatcgccgtcacgcaggcgcggctgccggggctgatcgtcgcctgggcggggatcgtgggcgtgaacttcctccacgcccgtcgcctccggcgcggtacgcaggatccccggggctgacccggggcccgcggccaccaccgccgcacgggcgagtgagccgaaggggcgcgccggggagtgagggcgaacgcgcggaggaaaccgtgaggcacgagcggttttcgagcacgtacgccgtcacgagccggcacaaggcgccccggaggcgaaccgagcccggaaaaggggattgcgcggggaccgccgcaccccggttgcccgggggcgggacgacggcggtccccgcgaaggacacggccgggtcagggccgtccgcgtccatggcgttcgcgtggtccgggagccgctccggaggtacgcacacgccgttccgtggtgccggccgggctccggtctcccggacttccctgccgacgaccaccactgtgccccagccgtgttaagccggtgctgccgccacgtgtcgggcccgtaccgtttgcgcgacgggcgtgccacggaccgtacgcccggggtgggaggcgggccgtgggcccgcgccccgttccccgggcgcgcggcaggctacttcgcgcccttggccaggaaggccagcaggtcctgacggctcaccacaccggtgggcttgccctcgaccagcacgatcgccgcgtccgcctcgccgagcaccgccatcagctcggacaccggctcgccggagccgacctgcggcagcggggagctcatgtgcttctccagcgggtcggtcagggaggcccgctgggcgaacagggccgccaggagctccttctcgaccacggagccgatgacctcggcggccatcacgtccgggtgaccggcgcccggcttgacgatcggcatctgcgagacgccgtactcgcgcaggacctcgatggcctcgccgacggtctcctcggggtgcatgtggacgagggaggggatgccgccctccttgtcgttcagcacgtcgccgatgcgcgcggcggggccggcctcctccagaaagccgtgtcccgccatccactcgtcgctgaagatcttgctgaggtagccgcggccgctgtccggcagcaggacgacgacgacgtcgtccgggccgaggccctcggccgccttcagcgcggccacgaccgccatgccgcaggagccgccgacgagcaggccctcctccttggcgaggcggcgggtcatctggaaggagtccttgtcggacaccgcgatgatctcgtcggtgacgtccgggtcgtaggcggtcggccagaagtcctcgccgacgccctcgaccaggtacggacggccggagccgccggagtagaccgagccctcggggtcggcgccgatgaccttgaccttcccgccgctgacctccttgaggtagttgccggtaccggaaatcgtgccgcccgtgccgacaccggcgacgaagtgggtgatcttcccgtccgtctggtcccacagctcgggaccggtggtctcgtagtgcgaacgggggttgttcgggttgctgtactggtcgggcttccaggcgccgggctcgcgcgcgaggcggtcggacacgttgtagtacgagtcagggtgctcagggtcgacggcggtcgggcagaccacgacctcggcaccgtaggcgcgcatcacgttgatcttgtccatggacaccttgtcagggcagacgaagatgcacttgtagcccttctgctgggccacgatggcgagtcctacacccgtgttgccgctggtcggctccacgatggtgccgccgggcttgagtgctccgctctgctcggcggcctcgatcatccgtacggcgatccggtccttcacggatccaccgggattgaagtactcgaccttcgcaaggacggtggcctgcaggccttcggtcacacggttgagcttcaccagcggggtattgccgacgaggctgatcatcgagtcgtggaattgcaccatgttctccaaggaggggactccacgggttctccgggaggtccggccagagtatgccgaaagggattggccgaccgtgcgtacggggcaggtaggggtcaatgaggaccgaggaggtggcctgaaggatgtccagggcgagaacagcccgccggatcgcggcgggggcagcgtacggcggaggcggactcggactggtcggggccgccgcggtcgggctggtggtggccgagatgcagttcgccaggcgggcggtgggctccgggctgccggagccaccgcgtgccgacgggctgtacgggagcgagttcggcggcccggagcagagcccggggccgctgcggctgggcatgctgggtgattccacggccgcgggactcggcgtacggcgggcccggcagaccccggcggcgctgatggcctccgggctggcggcggtggccgagcggccggtcgagctgcgcaacgtagccctttcgggggcgatgtcggacgacctggaccggcaggtcggcctgctgctggacggccccgccccacccccggacgtctgcgtgatcatgatcggtgcgaacgacgtcacccgccggatgccgccgacgcagtcggtgcggctgctcacctcggccgtgcgcaggctgcgcatggccggcgccgaggtcgtcgtgggcacctgccccgacctgggcacgatcgagccggtctaccagccgctgcgctggctggcgcgccgggtctcgcgccagctcgccgccgcgcagaccataggggtggtcgcgctgggcgcccgtacggtctccatgggggacctgctgggcccggagttcgccgcgaacccgcgggagatgttcggcccggactcctaccacccgtcggcggaggggtacgcgaccgccgccatggccgtgctgccgaccctgtgcgcggcgctgggcctgtggccggagtcggaccggctggacgtgtcccgggacgaggacatgctgccggtggcgaaggccgcgtcggcggccgcgggccaggcgggtacggaggtcacggccgcccgtggcccctgggtactgctcaagcaccgccgccggcggcgggtgccggccacggacccggcccagccggtggtgccgtagagggcggtccgggcgggctcacgccgcccgccgcgacaccggaccgccggcgtgtcgcgagcccgcggccggatgccgcgggcgagtgcggcccgtgtcacacgcccctgccggtgacctggaccgtacggggcggtaacttcgcttgcggtcccgcacagagccgcaacacacccttggagtcccgatgcccgaagccgtcatcgtttccaccgcccgctccccgatcgggcgcgccttcaaggggtccctcaaggacgtgcggccggacgacctgaccgcgacgatcatccaggccgccctggccaagatccccgggctggacccgcgcgagatcgacgacctgatgctcggctgcggcctgcccggcggcgagcagggcaacaacctggcgcgcatcgtggccgtgcagatgggcatggacttcctgcccggcacgacgatcacccgctactgctcctcctcgctgcagacctcccggatggccctgcacgccatcaaggcgggcgagggcgacgtcttcatctcggcgggcgtcgagatggtgtcgcggttcgccaagggcaactcggactcgtggcccgacacccacaacccgctcttcgccgacgccgaggcccgtacggcggccgtcgccgcgtcgaccggctccagctggcaggacccgcgcgaggacggcctggtcccggacgcgtacatcgcgatggggcagaccgccgagaacctggcccgcatcaagggcgtgacccgtcgcgacatggacgagttcggcgtccgctcgcagaacctggccgaagaggccatcaagaacggcttctgggcccgcgagatcaccccggtcaccacccccgacggcacggtcgtctccggggacgacggcccgcgcgccggcgtgaccctggagggcgtggagggcctcaagcccgtcttccgccccgacggcctggtcacggccgccaactgctgcccgctcaacgacggcgccgcggcgctggtcatcatgagcgacaccaaggcccgcgagctcggcctgaccccgctggcccggatcgtctccaccggtgtcaccggcctctcccccgagatcatgggcctgggcccggtcgaggcgtcgaagcaggccctgaagcgggccggcctcacggtcggcgacatcgacctcttcgagatcaacgaggccttcgcggcccaggtcatcccgtcgtaccgggacctggagatcccgctggagaagctgaacgtcaacggcggagccatcgccgtcggtcacccgttcgggatgaccggtgcgcgcatcaccggcaccctgatcaacagcctgcagttccacgacaagcagttcggtctggagaccatgtgcgtcggcggcggccagggcatggccatggtgatcgagcgcctgagctgagccgttgcgcgaccggggaatcgggcggccgcgcacattggatcaagagtgcgacccaggcgccgcaagggatccggccggatcccctgcggcgtactgacaccggatctaacccggtcgcggccgacctgtgaccaaatttcccccaggatgtgacctatctcctgggggatcggtgtttacgcaggtcagggccggtacagatgcgacgtgtgtgacgaaagccctgtccatttcgtgacgtaatgcactgcacgccattcccaggtcgggacactctgatgtaggaagtcgggggatcgaatcacctcaggagttagtcagtgagcgccatgtctcttgccctgctgctgaccacggccgctgccacggccgtgggcgctgctgcgctgcacgccgtccatggtctgcgcaagcaggtcgccgccctgcgcactgagctggcggtgccggtccacccccgcggtgcgaccgtcccgcacgcccgcagcgccgtggagtcccccgccgcggagatacgagccgccgtggccgaagccctcgccgaggagcgcgagcgcgagctggccgaggcgcgggccttctgggccgcgcaggaggcccgtgacgccgccgacgccccgtcgctgatgggcggtctgcccgggctcggcgaggacagcccggtcttcctgccccggcaggccgacctggtgggactggagcccgtactcggcgaggagatcctcgacgagctgcccgggtaccccgaggactcggccgagctggccgccgcgcgccggcgccacccctcgcaccccgacttcgtaccggtccaggcctcgcaccccggcgccgaccacgagcgcaccgtgaaccgcctggaggagctcgcggaggcccgtacggccctcgcggacgtccgcccgggcccgctgggcacgctcgacgtgtacgtgttcaccgacggcacgacgctgtgcatgaccccggggcaccgggagaccgcggagcggctcgccgaggccctgcgctccggcaccgcgccggtcctgctgggcggctcgggcatctccggcgcctacgcgctgaccttctcctgcggcgacaccgaggaccccgacagcaacgtctacatcctcgcggaccgcgtcatcgcatcgctctgacttccgcctgctccaccagccgcacggcctcgtccagcacctcggacggggccttcgcgccgtccggggccgcggcgcgcagggcctcggcgaggtccagcccggtcaccgccacctgatcgccgaccacgaagatgccggcgtccggcacttccttcggctcctgcccgggcgtctcgatccgctgggcccgtacggagagttcgcgggccaggtccagcgccgcggcggcggcgccctgctgcaggcggctctgcggcgcggcccgcagccggtcggcgaaacgttccacgacggcggtcaggggcgaagtatcaagcacccggccgaccttacgcgccgcccgggcaccattgccaacgggcgaactctccggcacggtggcgtgaagagaacagcacggcgatacctccggaggcgcccatgtccgtagagttctccgaacaaacccaccgcaacatgatcgacagaatccctctgaccaccggtcgtgacgtgtccgactggctccgcaccgtggacgaaggcccctcactcgtccggttcgaggagaaggtcagctggctgcgcggcgcgcacgagctgtcgtacggccaggccaaggcgatcatccacgagtacgacctgcgcagagccgcacgccggttcggctgagccctcctcccccgaccccgtgtcccgtaccccctggatgcgggaaggccccgcgagcggtgtgctcgcggggccttccccatgccgtgcgcgcgggccggtggccggcccgcgggtcctgctagtcgtcgcccgagaggatcgagaagatgcgcagcatctcgacgtagatccagaccagggtcatcgtcagggcgaaggccgcgagccaggcctcctcgcggggggcaccgtaggcgatgccgtcctcgacctgcttgaagtcgagggcgaggaagcaggcgccgaggatgacaccgatggcaccgaacaggaggccgaggccgccgctgcggaagccgaggccgtcaccgccgccgaagaccgcgaacagcgtgttcacgagcatcagcaggatgaagcccatcgtcgccgccatcacgaagccgtagaagcggcgggtgacgcggatccagcgcatcttgtacgcgaagagcacggcggcgaagacgcacatcgtgcccatcacggcctgcatgacgacgccggggccgacgtaggtgctcacggtcgcgctgatgacgccgaggaagacaccctcgaacgccgcgtaggccaggatcaggcccgggacgggcttgcgtttgaacgactggatgatcaccaggacgaaggcgacgagaccggcgccgacgccgatggcgtacgaagggccgaggttggccgggtcgaccggcagcaccgcccaggcgagcgcggccgtcacgatgagcgtgccgagcgtcatggccgtacggctcacgacgtcgtccatggtcatcacgttggcgcgggccggggcctgcggcatgccggtggtcgggtcggccgcgtacgggttggtcgcgtacgggttggtcccggcctgctgcggctgcgcgtcaaagcccgcatagccaccgttgtcgcggctgaacccccgtcgcgagaagaccgggttactgctcctcatctcactcctccgtggccaccgagcgcggccttgcatcaagagtaatgcgctcgcaaagaaagcaccctactgctggaggaggatcttaggagaggccgggccgggccgcagtaaataaagccgccggatccacacggcccccgttcggcggcgacccgcccccggaaaccggatcggccggggcggggcgctgttcacccggtgcggcgggcggtggccgaccgccttgttgacgtcgtcgccggggtgcgggcgacgcgcgtgctccccgtgttcccgatctccggagtggtcacgtcccgggaggatcggggctgccgggccgggcgccgtgccattgatggtgcccggagccggacttgaaccggcacggcccgaaggccagcgaggtttaagctcgccgtgtctgcattccaccatccgggcaaggcgtggcggcccccgttacaaagccttgaacgctgagccgagcctatccggatcgctccccctgccaacctgcgaactttccgatgttgtctgattttattggcgcttgagggttcgtcagggccgagaatgcacggtcggcccgttctggacgccgatcatcacctgtacgggaatgacgggatttcgatggcctccgccaccccccgcgccaccctccccgccaccccgggtcaccccgggccacccacgccgatcaggctcctgtcataccagaggaggacacggacccgcccgccgtcagactccagtgggccgaggaacaggcacggcggctgatccggagcgggggtacccgcggtgaggatggaaacgtccccgcaccgcagaccgaggagccgtcccgtgaccaccatgaactacgccccgcacaccacccaggccgtggccgcccgcgccaccggcctctccaaggtgtacggccagggcgagacccaggtggtcgccctcaacaacgtcaccgtggacttcgtgcaggggcagttcaccgcgatcatgggcccctcgggctccggcaagtccacgctgatgcactgcgtcgccggcctggacaccttctccgcgggctccgtccgcatcggtgacaccgagctgggcagcctcaaggacaagcagctcacccagctccgccgggacaagatcggcttcatcttccaggccttcaacctgctgccgaccctgacggccctggagaacatcacgctgcccatggacatcgccggccgcaagcccgacaagcagtggctcgactccgtgatcgacatggtcggcctctccgggcgcctctcccaccggcccacccagctctccggcggccagcagcagcgcgtggcggtggcccgcgccctggcctcccgccccgagatcatcttcggtgacgagccgaccggaaacctcgactcccgctccggcgccgaggtcctcggcttcctgcgcaactccgtgcgcgagctcggccagacggtggtgatggtcacccacgacccggtcgccgcctcctacgcggaccgcgtcatcttcctcgccgacggcgagatcgtccgcgagatgctcagccccaccgccgacagcgtgctggactgcatgaaggccttcgacgccaagggccgcacgagctgatccgggtcacccccgcagccctcctccagacttccagccccaggactcgaatcccatgttccgtacagccctgcgcaacgtcctcgcgcacaaggcccggctgctgatgacggtgctcgccgtcaccctcggcgtcgccttcgtctccggcaccctcgtcttcaccgacaccctcaagaagtccctctccggccagtccgccaaggactacgcgggtgtggccgtctccgtcacctcgtacggacagctcgtcaacgagaagggcgagaaggagggcgagcccggcctgagccaggccaccctcgacaaggtcaaggcgctcccgggcgtcgcctccgtctccggccgcgtcaccggcttcgccggcgtcggcgacgagaacggcaagctgatcggcgccggctggtccaaccagggcgccaactacacgcccgtcaaggacggcaaggacccgcgctacaccttcgtcgcgggcgccggcccggtcaaggccgacgaggtcgcgctcgacaaggcgacggcggaccagggcaagtacgcggtcggcgacaaggtgcgcgtcgcgaccaacggcccggtcaaggagtactccctcgccggtgtcttcaccaccgaggacggcgccgtgcaggccggcggcagcctggtgctcttcgagaccaaggtcgcccaggagctctacctcaagcccggctacttccaggagatgtcggtcgcggccaaggacggcacctccgccgagaagctgctcgccgacgtcaagccgctggtggacagcaagggcaccagggcgcagacgggcgccgcgctcgccgagaagcaggccaaggacatcgagaagggcctcggccagatgggcaccatgctgctcgtcttcgccggcatctcgctcttcgtcggcatcttcctgatctacaacaccttcaccatgctggtcacccagcgcaccaaggagctggccctgctgcgcgccgtcggcgccaaccgcggtcaggtcatgcgctcggtgctcaccgaggccctggtcgtcggtgccgtgtccgccgtcgtcggcctgatcagcggcatcggcctggcggtcgccatgcggtccgtgatcgagtccttcggcgccaagctcccgggcggcgacctggtcatcgccccggccacggtcatcgcggccctggtcatcggcatcaaggtcacgacggtcgcggccctgctgcccgcctggcgcaccggcaggatcgccccggtcgccgccatgggcagcgcccacctgccggccagcgcgaagtcgctggtcgtgcgcaacgtcatcggctcgatcatcagcgccatcggcatcggcctggtcgtgctcggtgtgtcctccggcggcgacaacggccgcatgaccatcggtgcgggcgcgttcttcatgctcatcggcatgatcgtgctgctgccgctgctctcgaagccggtcatcggagccgtccgcccgctgctgcaggcggtgttcgggatccccggcaagctggcctcccagaacgccgtccgcaacccgcgccgcaccgccgtcaccgccgcctcgctggcgatcggcctgaccctggtcaccaccctgtcggtgctcggcatcaccgtcggcaaggtcgtcgaccggatgaccaccgagaagctcaaggccgactacaaggtctccatggccggcggcatgggctacctcgacaggtcggtgaccgagaccctggccaagacccccggcatcaaggcggtctccccgcagacggccggctacttcatggtcggtgacgacttccggtcggcctccggcgtcaacccggccggcatcggccagctcctgaacatcgagaccgtcagcggctcggtggactccctcggcaagggcgaggtcctggtcgccgagaagaccgccaagagcaagaagctcgacaccggctccacgatcaaggtgaagtacgaggacggcaagcaggagaccctcaggatcggcgggatctacaaggacatggagggcctgctctccccgtacgtcctcgacgacaagatcctctcccagcacagcgaggagagcgccgtcagcgaggtctacgtcaacgtcgagggcggggcgtccaaggccggccagcagaaggtcgtcgacgcgctgggcaagaacccggccatcaacgtcgccacccagcaggacatgcgcaacgagatgggcggcatgatcaacaccatgctgaacgtcatgtacggcctgctcggcatggcgctgatcatctcggtgctcggtgtggtcaacaccctggcgatgtccgtcttcgagcggacccaggagatcggcatgctgcgggcgatcggtctcgaccggggccgggtcaagaacatgatccgcctggaggccgtggtgatctccctcttcggagccgccctgggcgtcgccatcggcatcttcctcgcctgggcggtcggcaccacgatggcgaagtccctgccgaactacgaactggtcctcccgtgggaccggatcggcatcttcctcctgctggccgccgtggtcggtgtcctggccgccatgtggccggcccgcagcgccgcccgcctgaacatgctgaccgccatcaagacggagtagccgcggcggcgggaccgtacggaaggccccggggcatcgccccggggccttccgcgttcccgtcccgccgccgttccgtgctgctagaccgtttctgcgtcccaggtgcgcagccgcagcggcagccgggcgtccccggacgccgtgggccgcaccgcgagcacctggttgaccccgagcctgccccgctcgaagccgagcgcgcaggccgccatgtagagctgccagacccgggcccggccgggcgaggtcagccgtaccgcctcggcccagtgctcctccagccgggccacccaggcccgcagggtcagcccgtagtgctcgcgcagcgcctccacgtcgcggacctcgaagccggcccgctccagttcgccgaccgtggtgccgagcggggagagctccccgtcggggaagacgtaggcgtcgatgaactcgtcgatccggtacgcctcctcgtccggctccggggggcgggcgatctggtggttcagcagccgcccgccgggccgcagcagggcgtgcagggtgcgggcgtactcccggtagcggtcggagccgacgtgttcggccatcccgatggaggaaacggcgtcgtacggcccgtccttgacgtcccggtagtcctggatccggatgtccaccaggtcggtcagtccctcgtccgcgacccgtttacgggcgtacacggcctgctcgcgggagagcgtgacgccggtgacccggacgccgtactcgcgggcggcgtgcagcgccatggagccccagccgcagccgacgtcgagcaggcggtccccgggccgcagggcgagcttgcggcagaccaggtcgagcttgtcgcgctgggcccgctccagggtggagccggggctccagtaggcgcaggagtacaccatcgaggggcccaggacccgttcgtagaagtcgttgccgacgtcgtagtggtggctgacggcccggcggtcgcggctcttgctgtggcgcgctccgccccgccggggcgcctcctcggcggggggcgggggcggcggcagcggtccggcgagggcgatcagctcgcgtgcggcggcccggtgggcggcgtcgcgccaccgcgccccgggcaggccggagagcggaggcaggccggcgcggcgggcgatgttcccgagggaggcgagcgggccgggcccgccctgggccgtggagacggtggggccgacgggcgggaggtccggctcgcgttcccagagcaggcccgccacccggtccagcaggtcgaacagacttccttcgaccgtcagttcgcccgccacccacgcccgggccagccccagctcgccgggcctccagagcatccgccgcacggcgcgacggtcgtggatgacgagcacggggccgtcgggcgggccggcctcgctgccgtcccaggcccgcacgcgtaccggcagcggggcacccagcagggtctcggcaacaacggcgagccgcggcgcggcgtcggtcatggcgcacctccacaaaagctccgacccctccgtctacccatccctggccccgggtacgccgaaggggccgcccgcaccacggatggcgggcggccccttcggggtcgtacaggtcgtacaggtcgtacaggtgaagcagatggagcagtgtgaagcggtggggctcaggtcctgccgggaggaccggtcaggaggccttggcctttgcggccggggcagcggcggctgccggggccggcgccggcttggcggcctcgtagaactcctcgcgcggcgtctccagcgcaccgagggagacgacctcgcgcttgaggaacatcgcgagggtccagtcggcgaagacgcggatcttgcggttccaggtcggcatggccatgccgtggtagccacggtgcatgtaccaggccagccggcccttgagcttgatcttcgtcttgcccatgacgatcatcgcgacgcccttgtggaggccgaggcccgccaccgcacccttgttggagtgcgagtactcggcctgcgggaagccccgcatgcccgagatgacgttgtcgccgaggaccttggcctgacgcagcgcgtgctgggcgttcggcgggcaccaggcgttctcgacgccggccttgcgggaggcgacgtccggaacctgggcgttgtcgccggcggtccagatgtagtccgtgcccgtgacctggagggtcggctgggcgtccacgtggccgcgggggcccagcggcaggccgtagcgggccagcaccgggttcggcttgacgccggcggtccacacgatggtgttggagtcgacctcgaggccgttcttcagcaccacgcggccgtccacgcaggagtccatggaggtgctgaggtagatctcgatgccgcgcgactccaggtgctccttgccccaggtgccgagcttgggcccgacctcgggaaggatcttgtcggccgcgtcgaccaggatgaagcgcatgtcctcgcgcttgatcgtggagtagtacttcgcggcgtcccgggccatgtcctcgacctcgccgatggtctccgcaccggcgaagccgccgccgacgaagacgaaggtgagggccttgcggcggacgttctcgtccgtcgtggactcggccttgtcgagctgttcgaggacgtggttgcgcaggccgatgccctcttcgacgcccttcataccgatgccctgttcggcgaggccggggatcgggaaggtgcgggagacggcgccgagcgcgatcaccaggtagtcgaagggcagctcgtacgcctcgccgaccagcggcgtgacgacggcgaccttgcggtcctggtcgatgctggtgacccggccggtgagaacctctgccttgggcagcacgcgtcgcagcgggacgacgacgtgccgaggcgagatgctgcctgcggccacttcagggaggaagggctggtaggtcatgtacgagcgcgggtcgacgaccgtgacggtcgcctcgccgtagcgcatcttcttcatgatgcgcttggctgcgtacaggcctacgtacccacctcctacaacgaggatcctgggacgctccgtggtgctcatggaacgagtatccagcacccaaaggggtgtcgctcgtgagccccttcacaaggagtgggagaccctctgctacactccgccgcccacgtgacggaggtcatgacgcgcgacgggaaccagacggtgtccggagtcgttgttcacccgtcctgaactggcctccagggccgaaagcggactggaccacaggcgttcgtccatacctctgacgcggatcccgccgcctccgccgatcgcacgaacgcgcgcgaaaaagggcctgcgggcctccggagggccccaaaggacccttccattgacccgacagaccctttttccttgtgaagaacttcacgaacttaatgtggatcacgggtccggggacccctcacaacctgcttcgaaggtcgttcaggcgatggaccaagcgattccatcgaggatgtcgtgctccgacacgacaacctcggaagcgccgatacgctccatgatcgccagcagcaccagagcgcccgccccgatcacgtccacccggcccggatgcatcacggggatcgccgcgcgctcggcgtgcgtctgcgtcagcatccgctcactgatcgcgcgcacctgctcgtaggagatccgggagtggtggatggccgtcgagaggtactccggcagccccagcgcgatcccggcgaccgtggtcaccgagccggccaggcccaccagcgtgcgcgcctcggacagcgggacgctctccgcggccaggtccagggccgcctcgatgtcggcccggatcgcggcgacctgctgcgcggtcggcgggtcggtgacgaccccgtccaccaccaggtgacgctcggtcatccggacgcagccgatgtccacggaccgggcggcccgtacgtgctcctcgccgaccacgaactcggtcgagcccccgccgatgtccaccaccaggaacggccgctccaggtgctcgtgcgccgtgagctccttggtggcgccggtgaaggagaactccgcctcctgctcaccggagatcacctcgggctcgaccccgaggatgtccaggacgccccggacgaagtccgcccggttctcggcgtcccgggaggcggaggtcgccacgaagcgcacccgctccgcgccgaactccttgacgacccccgcgtactcgcggcaggcggcgaaggtgcgctccagcgcttccggcgccaggcgcccggtccggtccacgccctggccgagccggacgatggtcatccggcggtccagctcgaccagctcgccggtggccgggtcgcagtccgcgacgagcagccggatggagttcgtaccgcagtcgacggcggcgacccgggtcacgcccgctgctcctcgtcgtccgtcttcttctccccgcagggggtgacgcaggcgcccttggcccaccactccggcagcatcgccagggcctcgtcgccgaacgggttcaccccggggccggcggccagggagtggccgaccagcacgtgcaggcacttcacccggtccggcatgccgccggcgctcgggaagccctggagcacctcgatggcgtcgcgccgctggatgtagtcctcgtgggcggcctggtaggcggcggccagttccttgtcctcggcgagccgggcctgcatctccttcatcacgccgttggcctccagcgtgccgatcgcggaggccgcgcgcgggcacgtcaggtagtacagcgtcgggaagggggtgccgtcggggagccggggggcggtctccaccacgtccggctgcccgcaggggcagcggtgcgcgatggcgcgcagcccgcgcggcgggcggccgagctgctgctcgaacgcctcgatgtccgcgtcggtcggctcggtccggtcggtctggggcgggggcgtctgcatgcctggaggaagtctcttcattctcgtggatgggtgctgcggtacggcggtacggatcactcgccggggcggtcggccttgtcgacgccgtcccagacgttggagtaccagggccggtcggagccggcctggccggtccggtgcggctgcgggggctgggccccggggtcgctcatgatgtagccgatctcccccgggcgcaggaagtgcaggtgcttgcgcgcctgctgttccgcgtaggcgtcgtcctgccagcgggccttctcgtcgcggagccgctccaggcggtcccgcgcggccgcggcggcccgctgctgcttcgcgatctccgagcgctgggagacgtactgacgcatcggatacgcgagggcgaccaccagcgtacagaggacgagcaccaggagcgcggcgcggccggtgagccggctgcggcggacctgacggcgcgactgcgaccggtagacgtgggcggcggtccgctcaccgagctgcttgagcctcgtcgcggtggagaaggtggagaaccgatcccggctcccggccattggtccgcctcccctaggtacgcgctacgcaatacgtccccgcacacggtacgggaccgagtgcggggacgtacggaggccagcccctcaggggggtgattagcccttgaagcgcgggaaggcgctgcggcccgcgtacaccgcggcgtcgtcgaggatctcctcgatgcgcagcagctggttgtacttggcgacacggtccgagcgggccggggcgccggtcttgatctgaccgcagttcacggcgacggcgaggtcggcgatggtgacgtcctcggtctcaccggagcggtgggacatcatgcacttgaagccgttgcgctgggccatctcgacggcgtcgagggtctcggtcagcgaaccgatctggttcaccttcacgagcagggcgttcgcggagccctcctcgataccgcgggccagacgctccgggttggtgacgaacaggtcgtcaccgacgatctggaccttcgcgccgaggcggtcggtgatggtcttccagccgtcccagtcgtcctcgaagagcgggtcctcgatggagaccagcgggtacgcctcgacgagctcggcgtagtagtcggtcatctcggcggccgagcgggacttgccctcgaactcgtactggccgtccttgtagaactcggacgcggcgacgtcgagcgcgagcgcgatgtccgtgcccggcgtgtagccggcctgcttgatggcctcgatgatgaggtcgagcgcggcgcggttcgactccaggttcggggcgaagccgccctcgtcgcccaggccggtggagaggcccttggtgtgcaggaccttcttgagggtgtggtagacctcggcaccccagcgcagcgcctcggagaaggactccgcgccgatgggggcgatcatgaactcctggatgtccacgttggagtcggcgtgcgacccaccgttgaggatgttcatcatcggaacgggcagcaggtgcgcgttcggaccgccgaggtagcggaagagcgggaggtccgaggcctcggacgcggcgtgcgcgacggccagggacacgccgaggatggcgttggcgccgagcgagcccttgttgtcggtggcgtccaggtcgaacatggcctggtcgatcagacgctgctcggtggcgtcgtagccgacgagctccgggccgatctgctcgatgacggcgaggacggccttctcgacacccttgccgaagtaacggtcggggtcaccgtcacgcagctcgatggcctcgaatgcaccggtggaggcgccggacggaactgcagcacggccggtgctgccatcgtcgaggcccacctcgacctcgaccgtggggttgcctcgggagtccaggatttcccgggctacgacgacgtcgatggacggcacgagcatctccttctgggatgtgacgctgagtgtgcggtggcgtgtcaggccgtgggatggccttgccgcctagagcctaaccggatccggggactcggccgcccgaccgcccggaccctgggacgaaaaagggaccgaatacccctcttccgggacatacatcgcttgatcatcgggcttcggggggcgaacgcggcaccgcccggcgcgtggagcacgcgccgggcggtggaaatcctgcacggggtcagctgacgccccgtacgtgttcctgcggcttctgccgcggtgttcagctgagcttcagcttctgacccgggtagatcaggtcggcgtccgagacgatgtccttgttcagctcgaagagctgctgccagccgcccttgacgccgttggcctcggcgatggtgcccagggtgtcgcccggcttgacctcgtacgagccgttgccggtcttcggcgcgaccggggcctcggcgcgctcggagcgggtggtcggagcctcggagcgcttggtctccttcttcggcgcggccttggtctcggccttcttggtctcgaccttcggctgcggcttcgactggggcttggactgcggcttcgacgccggggtctcggagccgccaccggcggaggaggagttcgacaggcccttgccgcaggacggccaggcgcccttgccctggctcttgaggaccttctcagcgacggctatctgctgcgccttggaggcctggttggcctgcggggcgtacgacttgccgccgtacccggcccacgtggacggcgagaactgcagaccgccgtagtagccgttgcccgtgttgatggcccagttgccaccggactcgcactgcgcgaccctgtcccactcggacgaggtggcggcgctggcggtgcccgcggccatcaggggcgcggccacggccacaccggccacaccggcgagcgtgacgatccggacagaccgctcgattgcagtaccgcgacggtgcttgcccttgccggaaagcagcatggagtttctcctcaccgacgcctacgaggtgagctgtcgggttcgggcgagtgagttgcccggccgtgcgacctagcgcacgtcttaaccccaagccggtggcgtgaccgtctctcaacggccgctcccggcacctaccttggttcccccgctcctgccttcggcgcttgacgcgacgactgttccctccgtccgccggcaggattcggcgatgcggtcgaaggagctcgcggtggcgagcgattcagaaggtagacaggtctctccccgatgttcaacgaggaacatcggggagaaacggccctacttgcgctcctttcaggggcgtttgcgcaggtgagggcggggtttgcggaagccccggagcgagacacgccagctgaccggaagagacgcatgtctcacttacagaaatccgacattcgactctttccggataactgaactgtccttattgcggagttaggtccaggttctggccgggcttgatgaggtcggcgtcctcgccgatgactttctcattggcctggtagagaccgttccagcccccctttacgcccttggcatccgcgatggtcgccaggctgtcgcccgcctggaccgtgtagacggggtccgacgagacgtcaggcagggccgacggctcggccgccgccgcaccgcggtgcttgccgctgccctcgacgggagtggcgccggtggtctgcgggacctccggggtcgcgggggccgtcgtgctgaccgggggaagcccgggcgtgacgggcgcggtggtgggcggcgcggtcgggtccaccggcagcgtcggcgccgtcgggtcgacgggcgtcggcgtgagcgtcgggtcgcccggctgggtcggggtcgtcggggtggccgggggcgtcgtcggggcgtccggggcgggcatgacgggcagtccgatggacggggcgtccgggatgaggaacggggtgctggacgggctcggagccggagccggggtcggcgacccgtagtccgtggacggcttgccgcccccggtggacggaacggcgtcgtccgggcgggacggcgcgggggccagcgggcccttgccgccgggcagaccggggtccacctgcgccgcggggccctgctggtccagcccggccgaggccgcgcacagcggccacgcctgcggtcccgtcgagctcagcacccgttcggcgacggcgatctgctgggatcggctcgccaggtcggggcgctcggcgaattcgagcccgccggcgctctgccactcctcctgggtgaactggagcccgccgtaggcgccgctgccgaagttggcactccaggagccgccgctctcgcattcggcgaccttgtcccacgtggacgtgtcggcggcggtggcgctggtggcggccaacagcggcatggccagcgctgagccagtgactcctgctgtgacaaccagcgcggggacctggcgggggcgtctgtgacggccgttcccggagagcatgagcgatcacctttcgcatataacagcggggtaacggcagaacctagcggccttcgaacgattgtcacaagttcaagccgaagctgacttttaatcagctttcgcgcaagtgttttgagccgcgaatcgaacgggaagagtgcgcagcccccgcatgatcaaccccccgcgccagcgcaggtcttggggtggaacggccagttccagatcgggcagacgcgtcagcaaagtcgcgagcgcggtctgtccttcgagccgggcgagcggagcgccgaggcagtagtggatgccgtgaccgtatccgaggtgctggttgtcggtccgggagaggtcgagggtgtccgggtccgcgaaccgctccgggtcccggtcggcggccgcgaggacgaccaggaccggatcgccggcctcgatcggcatcccgccgagggtcagcggctcggtggcgaaccgccacgtcgccagctccaccggcccgtcgtagcgcagcagttcctccaccccggtggccagcagaccgctctccccggcggcgagggagagctggaggcgctcgcgctgcccggggttcatgaagagggagtggaccccgttgccaatgaggttcacggtggtctcgaaaccggcgaaaagcaggatgaaagccatggcggtggcctcaccctcggtcagatggtcgccgtgatcgctcgcccggatgagatcggagatcaggtcatcacccagatcatcccttttgcggtgaatgagttcaccgagataggtccgcatctgcttcaccgaccgggccaccccgccccgcggaccgccgccgtggcggatcatcatgccggcccagtcgcggaagtcgtcctggtcctcgcgcgggaccccgagcatctcgcagatggcgtagatggggagcgggaaggcgaactcgtgaatgagatcagcctcacccttctccgcgaaggcgtcgatcaggtggtcggtgagcgcctgcacccgcggcgcgaactcggcgaccctgcgcggggtgaacgccttcgacaccagccgtcgcagccgggtgtggtccggcgggtcgatgttgagcaggtgcgtcatcagctccgccttgcgctcccccgggatcccggtcttgcccttggcgtgcgcgggctccgcgtggtgcgccggattcttgctgagccgctggtcggcgagggcctggcgggcgtcggcgtaccgggtgacgagccaggcctcgaccccgctgggcagcttggtgcggtgcaccggggagtgctcgcgcagccaggcgtaggccgggtaggggtcggtcgcgaactcccagccgaagagggtggggccctcggcggaaggggtgtcggcgggagtgtccgcgggggtctcggcgggggttccggaggtctgctcgtgcacctgatgaccgtatcccggcgccgaaccaccatccgatatgggcggttcgccgcggctgtccgtagatcggccatcccttgacctgaacttctccggcattcctactttcggttttgtggatgtcaggatcttgaagagcagtttcgcggtggtggagaggcgggccgagcacgccgtcaagttcttctactcccacctcttctggcacaaccccggagtccgcgccctcttcccggactccctccacgagatggaacgccagcgggaccggctcttcgccgcgctcacccacctgatcgcccacctcgacgacgagtcgctccgcccctacctgcgcgacctgggacgcgaccaccgcaagttcctggtccgccccgagcactacgcggccgtcggtgccagcctgctcgccgcactcgcggagacctccggcgaggcctggaccccgccggtcgagaaggcatgggccgaggcctaccaggtgatggccgacgcgatgacggccggcgccgacgcgagcgaggacccgccgtggtgggacgcggaggtggtacgccacctccagtacggaccggacatcggcgtgctgacgctgcggccgcacgcccccttcccctatctgcccggccagtacacgagcgtgagcagcgaacgggtcccgacgacctggcgcacctattccataggcaacgccccccgccccgacggcaccctcgacctgcacgtgagccgggtcgaccgggggcggctgagcaccaccctggtccgcgagacccggccgggcgacgtgctgcggctcggcgccgccggcgggcagctgaccttccgacgcgaggaccgcccggccagcctgatcgccgccggcaccggctgggcgccgatccgtgccctgctggaggacctcgcggaacgtccccccgatcaggacgtacggctcttcgtggtggcccgggacggcgcgcacctctacgaccgcccgctgatcgacgcgtacgccgccagctgcggctggctcgccgtcacctacatcacgcccgcccccgggcagcaccgcaaccaggccaccgaccggctcgcgaccgcgctgggcaaccggggcctgtggccggaccaggacgtctacctcagcggcccgccgcagttcatcgacgagaccgcccacctcctccaggagctgggcgcctgccccggccgcctcttccacgactccgtaccggcccggggccacggatacggggagcgcccgctgggcttcggcgagtggttcctggagcgcccggcgccccactggcacaacccctcggcccgcgcgccgaaggagtactgagaaggaccggaggactagagggtgtccggcggccggacgccctcggccgcccggatcgcgtcccggtaggcccgggccgccgcacgcagcgcggtctcggggtcgatccccgccgcctcggcgcgtgccgcgagctccagcagctcgtacccgacgccctcgccccggggcagttccacggccacgccgcccgcacgggcccggcccgcgagcttggcggcgagtgccaggccgggctggcccaccggaatcccgtcggtgaccgactcccggcgcttctccaccgccttggtgcgctgccagtgcgcgctgacgtcctccggggtctcggcctcggcgtcgccgaagacgtgcgggtgccggtggatcagcttcgcgacgagcgccccggccacgtcgtcgatggagaaggcctcgccggcgtcctcgccgtcctcgccgtccccgccggcctcctcggcgatccgcgcgtggaagaccacctggagcagcacgtcgccgagctcctcgcgcagctcctcccggtccccgtcctcgatggcctcgaccagttcgtacgcctcctcgatcgcgtacttggccaggccccggtgggtctgccgggaggtccacgggcactcgcgccggacccggtccatcacctggaccaggtcgagcaggcgcgcgcccggcagatcgtacgagcccggcaggagttccaggtcgggcatcgcgacccggcccgagccggccagccgggccagcccgtccgtgagccgctgatcgccctcgccgcccgggagcaccacgaccgtgcggccgcccgcgcaggcctcgaccagcgcctgcgcgtccgggctctcgaacgcgacctcgacgcccgcctcccgcaggtacggcagctgggggtggccggggtcggcgcacagcacccggtccgcggcgtgcagggtctgccaggccggccaggacagcacgccgggggcgacccggtggctggtggtcagcaggacgatgcggcccgtgggctcggcagcggcggcggtgggttcggagtggtcggtcaccctccgaacctacctccgacgcgccggtcctcggcccgggggaccccggagcctcaggctccggcgggcgccgcctcgggccgcgtccgctgggtgatccagggcgtctccccggtaccgagcttgatctccttggcgtcccaggcgccgtagcgcgggttcacctcgatgtgcagggccttgaccgcggcacgggcgggctcctccagcttcccggccccgtacttggcggtgagcgcggtcaggagcacccggtcccggaggaagcggtcgacctggccgggggccatggcccccttctgcagcagcagcgcctcgaactgctcgttgccgccgttctcgtcgacgtacgccttgcgttcgtcctcgatgtccttcggggtggccgtgagcccggcggtgtcggccatcttgtcgatgatccggctctgaaggagcgcgtcgagcttctgccgctccaggtggggggtgctcgcgatgagctccgcggcggcctgcccggaacggttctgcgccgcgcggacgtcgttgacctgggcctggagcgcggaggtggtgatgcgttcgccgcccacgacggccgcggtgccgggacgcggctcgcccgagcaggcggacagcaggggcgccgccacgagcagggcggcggagacggagagcgctgtgcgacggtgcaaaggagcctccagggccgggagattgtgcgtcggtgcacaaagggccgtgcggtgatcgatgttatgaggtcacggtgatccggaccaccggttcgaccaacgattcacgcgcggaccgaacacgcaccgttcataggcgaggcggcgggcgcccgcgtgtccggcgcgccacccgtcacccatcctggggacccgcgcgccgggcggcggccgggtcggccaccggcaaccctgaggccaccctccggtcacccgttcctgccaaggtcggcccaccatgtcgacaacgcactcctcaccgcgccgccggagtctgctcggctcggcgctcgccgccctcctcacggcggtggccgtgtgcgccggggacgccgccgcccgcgtgttcccctacggaccgcgccaccgcagcgtcaacgacctcggcaaccagttcgtccccttccacgcgcagctgtgggacctcctgcacggccgcgcggagggcgggctgctgttcaactggcgctccggctacggcatgagtttcctgccggacctgggcacctacctgaccagcccgttcgccgttctcgtcgggctcttcccgcgcgcggacatagacctcgccgtgtacgtcgtcaccgtgctcaagacggcggccgccgccgcggcgatggcctggctgctgcgcacgcagcgccgcgggccctggtgggcggccgggctgctcggggcctcgtacgcactgtgcggctggtcggtgatcgaggcctcgtacaacccgatgtggctggacggactgatcgccttccccctgctgtgcctgaccggtgagtgggccctgcgcggacgcaggtccctgctcgcgccgctggtcgtcgcggtctgctggacggcgaacttctacaccgcctacatggcgacgctgggtgcggcgctggtgctgctggtacgggtggtgctcacccgggagggcgcaccggcccggctgtccgtgatcgcccggggcgcggggaccacggtgctcgggatcgcgctcgcggcgcccgtgctcctgcccctcttcctcagctccgggcaggcctacccgggctgggtcaaggagttccggccggtgtcctgggccgacctgttcgcccggctgctgccggggacgtactccttctcctcccccgccgtcttcgtcggcaccgggaccctgctgctggtggccgcgctccccttccaccgggcggtccccgcgcgcacccggctgtggtgggcggggctgaccgcggccgtggcgctctccctccagtgggcgcccacgcacctggcctggcacctcttcgccaccccgaacggaagcccgtaccggcagaccttcgtcctcgccgggatcgcggtcatcgccgcctggaccgggctggcggcgggcccgccgcggccgccggccctggccgcgggtgcgggcctgctgacggccgccgcgctgtgggcgggcgacagcccgctggtgacgacggcgggctacgcgctgttcggcggcgggctggcactggcgggggccgcctggtgggcgctgcggcaccgccggctcgcgtggccggcggccggactgctggcgctggtcctgctggcgcaggccgccgcgaccaccgcctacggccacaagggcaagctgggcggcctggacgactacccgtcctggggccccgcgcacaccgcgcgcgccgaggccctggccggcgcggagggctggcccgcctaccgcaccgacccgggccggcccgccctgtcgggcaacgacccgctgctgctcggcggcgagggcggcgcgtactacagcagccacaccccggacgtcttcacccgcacgatggtcgcgctcggcgccggctggacctcgcgcggacgcaacgtacagagcatcgacaatccggtgacggacgccgtcttcgcggtcggcgcgcgcctggggcccgacggcacggtccgccgcgcaccggtgcccccgctggtgacgacccgtccgcccggcgccgcgctctcctacgccgacgactcccccttcgccaaccaggaagcgctgctgggcgcccgggtgtacgaggacccgctcgcgcccggggtctgccgcgcgggcacggaggcctacctgtgggcccccgagtacaacgcgacggcccgcctcgcggacggccccgccttccgcctgaacggcaacgccccccgcaaccgggcggccctccagccgctcggcgcctcccgcgggacctcctcggccctggtcttcgacgcggccccgccgccccggtggaccctgtcctgcctggaccgggcgcggctcgacgccgcggtggccggtctgcgggccacggcggcgacctccgtgcgggtcggcccctcgggcatccgggccgaactgccgcggggggccgccggcacggcggtcctctcggtccccgcgatcgccggctggacctgcaacggccgccccgcggccgcccacctggggctggtcgcgctgccgctgtcccccggcaccacacggctcagctgcgagttccggcctccgggcctggtcccggggctggcggtcgcggcgggcgcgctggggatcctggcggccgcggcccggtggggccggacccgccgccgggtcagcggacctggctgagccagtgcagggtgcggcggatctcggccgggaagggatgggccgggccgtgcagccgttccgcgtcgaacagcagccgggccagggtgtcgtgcgccgcctggcggtcgccgagggagagcagcaggtgggctatccggcggcggacctccagcggcagacccgggtccgggttggcgtagtggttctcgaagaacgggagcagcgagcggtactccgccagggcggcggccggctcgccgagttgctccaggcactgggccgagtcgtagcggaagcgcagcgactgggggtccccggccgggaactcgtcggcgaggcggcgcagttccggcagggcacgccggtactggccgtcgtccatgagcgtggcggcgtactgcttgcgcagggagcggaccaccggggagtgctccccgtgctcggcggccgccgccgggaggatgccgccgaggatgtccacggcctgggtgagccgcccctcgtccaggagcttgcgggcctcgtccacggcgccggggacgtcgggcttcggcggcgcgggcggggtgctcggccgcggcgggacgacggcggcccggtccggccagggtgcctgcgggcgcaggaagggccgggtcgggtcgagcgggccggacggggtgcggctgccgcgggcgggcagcagcggggccagcgcctcgtagacctcctgggcggaggagggccggtcctgcgggtccttggcgaggaggtggagcaggagcttctccagctccggcgggatctccgggcgcatctggcggaccgggagcgggggttcgtacaggtggcggtgcaggactccgagggcggtggatccggcgaaggggacgttgccgctgaggagttcgtagagcagcacgccgagggcgtacaggtcggtgtacgggcccacggcgccgcccatggcctgctcgggagccatgtaggcggggctgccgatgggcgatccggtgctggtgaggcgggtggtgtcggtgtccatcaccgaggccacgccgaggtccaggacgagcacggtgccgtccgggcggaccatcacgttgcgcggcttcaggtcccggtgcacgatcggcaccgcgtgcacggccgacaggaccgagcacagctgcgcgacgacggcgaccgcccactgccaggggtaggggtcgtgctcggcgaggtggtcggcgaggtcggcaccctccacgtagcccatgacgaggaagagttcgtcgccgtcgctgcccgcgtcgtgcacggtgaccaggcccgggtggtcgacctgcgcggtgacccggcactcgcgcacgaagcggcggcgcagctcctcggcgaccgtgccggggccggcgaccttgtcggggcgcagcagtttgacggcgacgcggcggtcgaggcgccggtcgtaggcggtccagacctggcccatgccgccctggccgaggacggtcgcgagctggtagcggtcgccgatgagccgttcggtcactgcggggggtcctggaacggggtctggtggggatcgtggcgggggcccccggccggcggggtctgcttgcgcagcagttcgctgagctcgtcgagctcggcccggacctgcccgatgcgcgggggcggcgtcggctgcggcggcacctgcgggggcgccggggccggcgtcggcgcgggggtcggcgtcgcggtggagggccgggtggtggccgtggccggcgggtagccgtaggagggcccggacggctgcgggtggacgtacggagcggactgcgccgggtaccactgcgcggtcggggccgaccgccgggcctcgtggtgcttgatgtcggcgacgaggaagtacacgcagatcgcgaaaccgctgaagatcgagccgccggcccccaggttgccctgccagccgttgacttcgggcgtggggtcggcctggatgagcgccatccacacgacggcgagcacgccgctggtcaccatcagcgcccagtcacgggacttgcgggtgaccagggcgagccgcagcagcgacccccaggcgaggaagccgcagctgaggatgggcagcagcacgaacaccacgcgcaatgccatcacaccccccgaatcggactgggggccgtgctgcggcggaaggccggggccgtgcatcgctgctcctgacgggccgtgcggaagaagtttcgggtctgagggtatacagcgttcccggccaggggtgaggggatgcgcgcaaccgttgcatgctcgctgcacggccgttcactccggcgtgaccgtgccgtcggagaggccgtcgtggaaaccctgtacgagttgttcgccgagccgtcccgccagccgcagcgcgtcctcgaactcggcgagcgcgcggaagcggagtccgtagctctgctgctgcgccaggggcagccggggcagccggagccggcgtacgtcgagccgggtggcggtggaggcatggctgctggcgcggcggttgttggcggtgccgcgcaggaatccggccaggaaccacgggtcgagggcgtccgggtcgggccgcagcagggccaggccgcggcccgggaccgcgcccgcggtcgcgtcgtcgacgacccgggcgatggccgcgccgccgacgagggggacgaggacgtcgccgggggcggtgagcacgggctcgtccgcggtgggggccagggtgccggagggtcctgttccggcgtagacgtcgtgttcggtgaggacgggggccgagccggttccgccgccggtgccggtgtgcagctccagggctccggcgcgggcgagttcgccgacggtggtcagcggcggccgggccgtgcccccggcgggcgcctccgcgggcggcggggtgagccgggcggcccggccgagggtctcgccgagccgctcccgtacggcggtcagttcggccggaccgccgccggcggccggcgggggcaggtggcgggcgggggtgaggtccacgtcgtcgtccagcagctcgatgacggggacgacgcggctgacgccgggcacgtgcgccaccgacccggtgcggtcgtacgtgctccaggcgttctgcaccgtttcgtgcacggcgggccaggcggagcggggttgggcggtgtcggcgccgagggccgcggtgtcgatgaggagcagcccggccgggggcgccgcgtgcggggcgggccggcgcagcacccacaggtgcagggggatcccgtacgggggcgccgcgccggccgggagcgcgacgacggcccgcagcgcgccgcggcgcaggaggtcggcgcggatgcggcggccggagcggcgggcggcgacggcgggcggcatgaggagcacggcggtgccgccctcgcgcaggtgggccagggcgtgctggacccaggcgagttcggattcggtgcgggccgggaagccgtactcccagcgcgggtcgtaggccagttcctcgtggccccagccgcgttcgttgaacggcgggtggcagagcacggcgtcgacggtgtcctgggtgaaggcgtcggcccgcaggctgtcggcggcgacggcgcggacctggggcgttccgttcagggcgaggcgcagggcggcgagggcggcgagttcgggcgcggagtcctgcgcgtggagggcggtggcgccggggacggcccgcaggagggtgccggtgccgcaggcggggtcgaggacggtacgggccgcggggccggcgagggcggccatcagcgcggcgaggccgtccggggtgagcgtgtactggcgggggttggcgtcgaggtggcgcccgaggaggaactcgaaggcctggcgggccccgatttcggcggcgagttcggcggcggcccgcagcagcggcatggcggccgggcccggcggggtctcggcgagcgcgtggccgggcccgaggcgcgcgccgagcacctggtcgaggacgggcggcagcagggtggccatgcgctcgtcggagacggcggtcagctccagccagtcggtgggcctgtcccgtacgacgagcagggcgccgcccgtcttgacgagtgcggtgacggctccgccggggtgggcggtgatctgctgccagacccgttcgcgcagcgggatctcggcgagcttgccctgggcgcgcagccagtgctccacctcgtccagggagaaggaggggctggtctcggtgccgccgacgggcttggggaagtcggcgtggcggcgccgccagttgctcacggcggcgcggccgactccggccaggcgggcgacctcggccgcggtgacctctgcggcggtggcctctgcggcgttctcctcgggcatgccggggagcttacccggtcacacccaagagaccgattcacagcgtgaactcaagaacttctgtgaaccctgttgactcggttcacatgaatctgttgtgatcagtgcgtcttcaccgccgaacgacggccgctccgcgtcaaccggaatacaatcttccacttctcctttaatcttcctttactccaccttcgagtcgccctagagagtccccatgcgcaccgctccccgtttcgccgccaccgccgccctcgcctgcgccgccgccctcggcctcaccggctgcttcgcctccggcccctacgccgacctgtccggttccgaggtggcggacaagtccgtggacgccctgcgcggcgcctcctcgctcaccgtgagcggcaaggtctgggacgcgggcaagccgctggagctgagcatggccgtcagcaaggccggcgactgccggggcaccatcgccggccaggagggctccttcgagctgatccgcaacggcgagttcgtgtacatcaaggccgacgagcccttctaccgctcgcagatgaaggacctgcccaaggcggaggcggacggggcggtcaagatgctggcgggccactggctgaagtcgaaggcctcggacgccgactcgaaggagctcgcctccctgtgcgacctggacgagctgctcaaggacttcgacgacagcaagggcgcggagaagggcgaggtcacctcggtcgacggccagaaggccctcaccctgaccacgaagaccgacgagggcaccgagaccctgctggtggccaccgagggcaagccgtacctgctcaaggcgggcgtcaccggcaaggagccggccgagatctccttcacgggcttcgaccagccggtccaggccgaggccccggccggcaaggacgtcatcgacgcggaccagctgggctgagccgccgggtacgcggaacggccgtggccgaagacctgtgaaggtctccggccacggccgttcccgtcgtcaccgcacccgctacgagccgaggatggtggtgaggaactcccccgtccaggccagcagttcccggccgaccaccggcttgccgccgatcttgcccgccttggggcgcggcaccagcacctgcgaggtggcgggcttgagcacggtccccgggtagagcctcttgagccgcagctcctgcgactcgcgcagctccaccggcccgaaccggacgttgttgccctggagggtgatgtccccgaccccgcaggcccgcgccagcatccgcagcccggccaccagcagcaggttctccaccggctccggcagcttgccgtagcggtcggtgagctcctcgcggacggccttgacgtccgcctcggaggtggccgaggcgatggaccggtacgcctgcagacgcagccgctcgccgggcgcgtagtcgtgcgggacgtgcgcgtcgaccggcagctcgatcttgacctccagcggcggctcctcctccacaccgccctcgaccgccgcccggtagtcggccacggcctcgccgaccatgcggatgtagaggtcgaaaccgacgcccgcgatatgaccggactgctcgccgccgagcaggttgcccgcgccgcggatctccaggtccttcatcgccacgtacatgcccgcgcccatctcggtgtgctgggcgatcgtcgcgagccgctcgtgcgcggtctccgtcagcggcttctccggcgggtacaggaagtacgcgtacccgcgctcgcggcctcggccgacccgcccgcgcagctggtgcagctggctcaggccgaagttgtcaccgcgctccacgatcagggtgttggcgttggagatgtcgatgcccgactcgacgatcgtcgtcgagacgagcacgtcgaacttcttctcccagaagtccacgacgacctgctccagggcctgctccgacatctggccgtgggccgtggcgatccgcgcctcgggcacgatctcgcgcagcttggcggccgcccggtcgatggactcgacccggttgtggatgtagaagcactggccctcgcgcagcagctcgcggcggacggccgcgccgatctgcttctcctcgtacgggccgacgaaggtgagcaccgggtgccgctcctccggcggggtggtgatcgtcgacatctcgcggatgccggtcaccgccatctccagggtgcgcgggatcggcgtcgcggacatcgtcagcacgtcgacgttggcacggagcttcttcagctgctccttgtgctccacgccgaaccgctgctcctcgtcgacgatgaccaggcccaggtccttgaaccgggtctcctgcgagaacagccggtgcgtaccgatgaccacgtccaccgagccctcctgcagcccctccagggtggccttggactcggtctcgctctggaaccgcgagagcgccttcaccttgacggggaactggctgtagcgctcggagaaggtgccgaagtgctgctgcacgagcagggtcgtcgggacgagaacggcgacctgcttgccgtcctggaccgccttgaacgcggcgcggaccgcgatctcggtcttgccgtagccgacgtcaccgcagatcagccggtccatcgggaccgacttctccatgtcctccttgacctcggcgatggtggtgagctggtcgggcgtctccgcgtacgggaaggcgtcctccagctcgcgctgccagggggtgtccggtccgaaggtgtggccgggggcggccatccgcgcgctgtagagcttgatgaggtcggcggcgatctccttgaccgccttcttcgcgcgcgccttggtcttggtccagtcggcgccgccgagccggtgcagggtcggggcctcgccgccgacgtacttggtgacctgctccagctggtcggtggggatgtagagccggtcgccgggctgcccgcgcttggctggcgcgtactccaccagcaggtactcgcgggtggcgccctggacggtgcgctggaccatctcgacgtagcggcccacgccgtgctgttcgtggacgatgtagtccccggcctccagggtcagcgggtcgatcgtcttgcggcgccgggtcggcatccggccgaggtccttggtggcggtgcgctggccggtcaggtcggtctcggtgaggacggccaggcgcagcaccgggtcgacgaagccgttgtcgatcgagccgcaggcgacgtgcaccaggctcggctccagggtgcgcagctccggctccagccgggccgcgatgccctcgccgccgagcacctcgacggtacgggcggccgggccgtggccctcggtgaggtagacggtgtgccagccgtcggcgatccagcccttggtgtcggccagcgcccgggcggtgtcgccgcggtaggcctccggggcgtgcatgccgagcttgagggtgtcgccgccgcccgcgctctcgtcggcggcgaacggggagaccgaccaccacatcatgtccagctcgcgggcccggtcgcggacgtcggcgatcccgcggagcgaggcggcgccgacgtcgatgggggcctcgccgccgcccgcggtggccgcccaggaggccatcaggaactcctggctggtcgccacgaggtcggcggcccgggtccggacccgctcggggtcgcagacgacggccatcgacccggcgggcaggacgtcgatcagcagttccatctcgtcgacgaggaccggggcgagggactccatgccctccacggcgatcccctcggcgatcttgtggaggagttcgccgagctcgggatgggcctcggcgagggccgcggcccgctcccgtacggcgtcggtcagcagcagctcgcggcagggcggggcccacagtccgtgctcggcgatctccagggaacgctggtcggcgaccttgaagtagcggatctcctcgacctcgtcgccccagaactcgatgcgcagcgggtgttcctcggtgggcgggaacacgtcgaggatgccgccgcgcacggcgaactccccgcgcttctcgacgagctcgacccgtgcgtacgcggccgcggccagtgcctcggtgatctccccgaggtcggcgccaccgccctgccgcaggctgaccgggaccagctccccgagccccttgacctgcggctggagcacggaccggatgggtgcgacgagcacgctcacgggacctgccgccgggtcgtccttgctcgggtgcaccaggcggcgcaggacggcgagccggcggcccatggtgtcgctgcgcggactgagccgctcgtgcggcagggtctcccaggacgggtagtccaccacctcgtcggggggcagcagcgagcgcagtgcggcggccaggtcctcggcctcgcgcccggtggcggtgaccgccagtacggtccgcccggtctgccgggccagcgcggcgatcgcgaagggccgcgcggcggcggggccgaccaggtccacgtgcatgcgcttgccgtccccggccgcggtgaccgcctcggcgagggcggcatcacgggtgacggcgtcgagcagtccgtgcaggctcatgaagaggctttccgtccggtgaaggtctggagtgtgaaggtgcgggggtgcggagcgggcaacgcgaagggcccgacacgtcgcacgggccgggggttcccaccctacgacgacgcccctcgcgccgctttacgatgttcctgttctgactgtccgagctcgccgtgtcgtcttccgccggggagaccatgacctccggaggagcacgagtccgtgacgagcgatgcgatagcccgcccggcgccggtggaaccggcagccgtgaagccgggccggagccggtgggcgccgccctggctggtggccgccgggctgttcctcgtctacctcgcgctgtccgtcggacggttccggcggatggactgggcctcctgggacctggggatcttcgagcaggcgatccgcgcgtacgcccacttccaggagcccgtcgccgacctgaaggggccgggggccaacatcctcggggaccacttcagcccgatcatcgcgctcgtcgcccccgtctaccgggtcttccccgggcccgtcaccctgctggtcgtgcagtccgcgctgttcgcgctgtccgccgtgcccgtcacgcgggcggccgtgcgcttcctcgggcgggcccgcgggctcgccgtcggcatcgcgtacgggctgtcctggggcatccagcgggccgtcgagttcgacttccacgagatcgccttcgcggtgcccctgctggccttcgccctggaggccgtgctcgcccgccgctggcgggccgccctgctgtgggggctgccgctggtcctcgtcaaggaggacctcggcttcaccctcgccgcgctggccgtggtggtggcctggcgggcccggaccaccgaccggcggaccgccctgaccgcgctcggtgtcgccgccgcggcctgcgtcttcgccgtcctggtgttcaccgtcgtgataccggccttcgccaccgcgggctacggctactgggacaagatcgacggcgcgggtccgctcggcggcatcggcaccaagctcaccaccctggcgtgggtgctggtccccacctccgggctgctcgccctgcgctcaccgctgctcctggtggccgcgcccaccctcggctggcggttcctttccggggacgaccactactggtccaccgactggcactacagcgccgtactcatgcccgtcgtggccctcgccctcgtcgacgccatcgacaccgtccggcgcggcgagcggccctggctgcgctcgtacgccctgcagatgccgaccgccgtgctcgccgccgccctcgccctgagcgcgaccgccatgccgaccgccaagctcgccgaggcccgtacgtaccagaagcccgagcgggtcacggccatcgagcggctcctggaccggatccccgacggggcgaccgtggaggccgacaccaccccgctgacccggctgacctcccgctgccgcgtgctgtggatcggcgggagcaagggcgtggtccccgactggatcaccatcgacaactcctccaagtgggccggcgaggacccgaccggctacgccctccagctccaccccggcgagcggttcaccctggtgggcgaggccgccggcatcgtcctgatgcagcggcagtgaccggggagaaggcccggcccgggaacgacgccggtccgggaccctgaggtcccggaccggcattcccccgaacgaacgcgggcggttactcgctcgcgatcgcgttcagtacgttcatccgcccggcccggaaggccgggaccagcgcggcgaacaggcccacgaaggccgaggcggcgaacaccccgaagatcgtcggccacgggatctccagcaccttgaggccttcgagcgcgagcagctgctgcgcggtcgcgccccagcccatgcccagcccgaggccgagcagggcgccgaagagggcgatgaccaccgactccaggcggatcatgcggcgcagctggcggcgggagaggccgatggcgcgcatcaggccgatctcgcgggtccgctcgaccaccgagagggccagggtgttcacgacgcccaggaccgcgacgacgatcgcgaggccgaggaggccgtagaccatgttgaggagctggccgacctggtccttcagggcctgcttgtagtcggtctggttgcgcacgctgtactgcgggtactgcgccatcgcggccttgaccgaggcgtaggcggtgtcggcggactgaccgtcctgcgcgctggccagcagcatgaaggggagcggcagcttgtcggccgggacgttcgcccgggcgacctcggtgctgacgtacttcatggtcttgtcgatgttgccgctgtcgctggtgatcgccgcgaccttcagcttgaccgtgttgccgccggtgaaggcgaccgtcagttcgtcgccgagcttgacgccgtgcttggtcgcgtactcggagcccaccgacatggagtccttgccgtacgccgccgcgtgctccccggcgaccatcttgcgccggatgtccttggcgtacgtcgggtcgttggcgccgaggcccacctcctcgctggtcccgtcgggggcggtgatcttggccggcacctcccggtacgcggtgacgtggtcgaggcccttggtggcgcgcagggcctgctcggcctgcggcagcacgggctgccctgtctgggactcgacgatgtagtccgcgccgaccgacttgtcgagctcgtcggtggcggaggccaccatggaggagccgaccacggacaggcaggcgaccagcgcgaggccgatcatcagcgcggcggcggtggcgccggtgcggcgcgggttgcgcagggcgttgcgctcggcgagccggcccacggacccgaagggccgcagcaccacgccggagagcacccgcaccacgcccgcggccagcagcgggccgatcacgatgaagccgatgagggtgaagacgacacccaggcccagccacagcgatccggggccggccttctcggcggccgcggcgaggaagagccccgcgccgccgatgccggtgaggaccaggccgaggacggcgcggacgacgccggccttcttgtcgcccggggttccggactcgcgcagggcggccatcggggagaccttgccggcccggcgggccgggacgaaggcggagacgacggtgacgatgacgccgaggacgaggccgacgacgggcgtggtccaggcgaccgtcaggtcgtcggtggacaggtgcatgcccatctggcccatgagggccatcaggccgacggccaggcccacgcccgcggcgacacccaggaccgagccgaccacgccgagcaggaaggcctcgacgaccacggacttcaggacctgtccgctgtcggcgccgatggcgcgcatcaggccgatctcgcgggtgcgctgggccaccagcatggagaaggtgttgaagatcaggaagatgccgacgaggaaggcgatgccggcgaagccgagcatcacgtacttcatgacgtcgaggaaggcgccgacgtccttgcggttggagtctgcggcttccttggcggtctgcagcttgtacgtgtccgcgccgacggccttggcgacgttctgcttgagctgctcgtcactcaccccgtccgcggcggtgacgttgacgtgcgtgaaggagccgggggagccgagcagcgcctgctgcgcggtggccgtgtcgaagtagacgacggccgcgcccgggttggtcacggtgaaggcggcgataccggtgatcttggcgcggatgtcgccggtgacggcgatggtgcgcagttcgtcaccgaggccgaggccgtgcttcttcgcggtgtcggcgtcgaccatcacctcggtggggccgcgcggcgcctgtcccgaggtgatcttcatggacttgagctcgttgtcgctccagttgcccgcgatggtcggggcgcccgtggtcgagcccatgttctcgttcttggcgttgaccaccgtgacggccatcgagacgacgccgccctcggcgctcttgacgccctcggccttcttgacctgctcgacgaccgagcccgccagcatctcgggcttgccccgggcgggggtctcctccccgctctcggcgctcttggggctgacggtcacgttggagttggtgacggcgaacagcttgtcgaaggtggtgttcatggtgtcggtgaacaccagggtgccgcagacgaaggcgacggagagcatgaccgcgacggcggagagcgccatccgtcccttgtgggcgacgaagttgcgccgcgaggtcttcaggacggtgttgctcatgaggtccgcccgcgcgcgtcgaagtccttcatgcggtcgaggacctggtcggcggtgggaccgtacatctcgtcgacgatccggccgtcggccaggaagatgacgcggtcggcgtaggaggcggccaccgggtcgtgcgtgaccatgacaatcgtctggccgagctcgtccaccgagcggcgcaggaagccgaggacctcggcacccgccctggagtccaggtttccggtcggctcgtcgccgaagatgatctgcgggcgggcggccagggcgcgggcgaccgccacgcgctgctgctggccgccggagagctcggtcgggcggtgcttgagccggcccgcgaggcccaccgtctccacgacccggttcagccactccgcgtcgggcttgcggcccgcgatgtccatggggagcgtgatgttctccagggcgttgagcgtgggcagcaggttgaaggcctggaagatgaagccgatccggtcgcggcgcagctgcgtgagcttcttgtccttcagcccggtgatctcggtgtcgtccaggtggatctggccgctggtcaccgtgtcgagaccggcgaggcagtgcatcagcgtggacttgccggagccggagggacccatgatcgcggtgaactggccgctcatgatgtccacgtcgacgtcgtcgagggcgacgacgcgcgtctccccggagccgtaggccttgacgacctttcgcgcccgggccgcgacggctgcatgccctccagtacccccgtgcctggtttcggtcatcgccgttgtcacggtctttctccctcttcgaatgcgtgcgtctgcgtcgtacgtctgcgtctgtgcggccgtgtccgtgcggccgtgtcgtgtacgacggctgtgcgctcgtcgtcgtcatgaagtctccgccgggcgggagcgcggcgcgctggtgcccatcgccgtatccgcccgggggttaaccccacccccggcctggtccgtaggctccagttaaggagacatcggggccgctcacgtcctccgccgggaggaacgacccctggcccgttgtacggagggccccctaggggatctgcccgctccggcggacgcgccctcggggatactgcccggcacgcggcggtgagatggtgttccccgcagttacgtgcagggggaaggaatctcggtggcatcggcggagagcacgggcgcgagcccggacggcataccctcgcggcccccggcggacacccccggcgccggggtcgcggccgcaggcacgaccggcggcgcgcccgcggacaagccggccgcgcggcctcccgccccggtggtcgcctcgctgatgctcggcatggccctcgtcgccctggacagcaccatcgtggccaccgccgtcccgcagatcgtcggcgaactcggcggattctccgtcttctcctggctcttctccggctacctgctcgccgtgacggtcaccctgcccgtctacgggaagctctccgacaccttcggccgcaagcccgtcctgctcttcggcatcggcctcttcctcgtcggttcgctgctgtgcgcgtccgcctggaacatggccgccctcatcgccttccgcatcgtccagggcctgggcggcggcgccctccagggcaccatccagaccctggccgccgacctctacccgctcagggaccggccgcggatccaggcccggatgtccagcgtctgggccacctcggcggtggccggccccgcgctcggcgggctgctcgcctcgtacgcgcactggcgctggatcttcctgatcaacctgccgctggccggcctcgccctgtggatgatcacccggcacctgaccgagcccgtacgctcccccgggcgccggggaccggtcgactgggcgggggcgctcgccgtgttcgcctgcggcgggctgctgctcttcgcgctggtccagggcggggtcgcctggccctggctctccgcgccctccctcggtctgctgggcgcgagcgcggtgctggccgcggtcgtggtccgggtggaacgccgggccgaggagccgatcctgcccggctgggtgtggcgccggcgcaccatcgccgccgtcaacctggccatgggggcgctcggcctgctgatggtcgccccgatggtgttcatgccgacctacgcgcagtccgtgctgggcctcggccccgtcggcgccggcctggtcatgtcggtgatgaccctgagctggcccgtcagcgccgcctgcagtcagcacgtctaccggcgcatcggcttccggaacaccgcggccgtcgggatcgcgctcgccgccgtgatcctgttctccttcaccctgctgccctaccccgcccggccctggcagccggcgctgatcatgctgctgctgggcggcgccctcggcctcttccagctcccgctgatcgtcggggtccagtccaccgtgggctgggccgagcgcgggaccacgaccgcctccgtgctgttctgccgccaggtcggccagagcgtgggcgcggccctgctcgccgccgtcgccaacgccaccatcgccgcgcgcctggcgggcgcccccgtacccggcctcccggagcacctggacgacgtggcgaaggcgctggaccggccggagctgctgcccgcggccgccgccggccacctgcgcggggccgtggccgccgccgtggagcacatcttcctcggcgcgacggcggccgccgtggccgcgctgctggtcctgctgctggtggcgccgcgccggttccccgtcctgccggaactgcgcgaggagtaggcggagtcggcggagtcggcggagtcgggggcaggaaggacggtggagcacggaaagtcgccttgtcatggctgggccaatgggtaaccctcgtgccaggaccgtttccggggggacgacgacatggcatccgcactctgcgcactcgcgttactggccgccctggccggcccgatctgcctgcggctccgccgcagcccgggcttcgtcaccgggcgcgacggccgcctctccacctcgacggcgctcgccctcgcctggaccgtggtcctggtctggctgctgctggcgatcctcggctacgggctcaccgcgggcggcggcatcgcgtacttccggggcaccgacggcccgctgtccaccctgaccacggtgtacctgccgctgctcggcggcccgtacgtggccctgatcgccgcgaaggccgtggtcggcctgcgggtggagcacggcagcatggccaagcccgccgcgaagccgacggcgtcggggcggcggccgctgcgggagctgatcgcgaacgacagcgggcgcaccgacctcgtggacctccagtacgtcaccctcagcgcggtcaccatgctgtacgtggtgctgttcttcctcgcggacgtgggcggcggactgccgcgcctgcccgccgagatgtgggccctgacgggcgccccggcgggcgcgtacctggtcaacaagatggccgtccgcgccaacccggtgatcacgcacgtcacgctggagggcgagcgcctgacggtcgagggcggcggcttcgcgccggaccccgcgggcccgcccgccctcctcaccgtcgacgacgtccccctgccgaccctgaccgaccccctgacgggcgccctcacggccaccctcccggctccggggacacccccgttcaccgtggtcgtcacggcacgcggcctgcggagcgacccgtaccgctacgagtccccgacgaagcccgccgtcccggcccagcagcggccggcgggctgaccggcacacggcctcagtccgtatcgcccttgtggcgggcgtagtagcgggccacccgggcgcggttgccgcagaccgacgccacacaccagcggcgtcgggggtgcgccggcaggaagagcaggacgcagtcgtgcgcctcgcactcgcgcacctgccccgcccgggggtccgtcagcagttccgcgaccgcctcggccagctccgccgcgagcctccgggccgggtccgccggccggtgcgcggcggcggtgatcccgccctcctccgcccaggccagcacgcggtgcgagggcgccgcggccagggcctcgttcagcgcgcgcagcgccgcggccgggggccgctcaccgcgccgcacggcgtcgagcgccgggcgcgcggcctcccgtacggcccggacggcggctacctcggcctcacccacggagtcgacgggggtcagccgtccggcctgcgcggccagccaggccgtgagcgccgccgggtcggcgacgaggtcgcccgtggcggcctcggtgttgaggaggtccagtgcgaggggctcaccggtgagcgggaaggtcactgtcacccgactaatgctacgacaatcccttgacccattagcgatcacaggcaagactaatggaaacaagaacgcaggaggcatgtgatgacgactgttcgccgcaccgttcccaccatccggcaccgcaccgccgacgtggacggggtccgcgtcgcctaccgcgagagcggccccgccgacggccccgtcctgctgctcctgcacggcttccccaccgcttcgcaccagttcgcccgcctgatggacgccctcggcgacaccccgtaccgcctgatcgcccccgactaccccggcttcggccacaccgaggccccggccgggttcacgtacaccttcgaccggctcgccgacatcgtggagggcttcaccgacgtcctcgggctggaccgcttcgccctgtacgtcttcgacttcggcgccccggtcggactgcggctcgccacccgccggccggagcgggtgaccggcctgatcgtccagaacggcaacgcctacgaggagggcctctccgacgcggcccgcgagttcgccggactccggcgcgaggtccccggcgacgaggaacgcgtccgggggctcttcaccctggagggaacccgcttccagtacgagaccggcgtcgccgacaccggcctcctctcccccgacagctggatcctggacctgcgccacctcggcctgccgggccgcgccgacgcccaggccgacctcgccttcgactacgcctcgaacttcgcccactaccccgcctggcaggcctggctgcgcgccgcccggatcccggtgctggtcgtgtggggcgccggcgaccccttcttcaccccggcgggcgcgaaggcctacctccgcgacgccccggaagccgaggtgcacatcttcgagggcgcgggccacttcgccctggagacccacctcccgcagatcgccccgctgatcgaggacttcctcgacgcccgcgtccgagccgtcccgtccggacggtcctgagatcacggcccgtccgaacgggacggcctagccttccgccggggcccggcccgtcagggccgccaggctggagcggacgtggttcatgtgcgcccgcatctcctccgccgcctccccgtgctcccgcaggatcccccgcgtctcgcgcccggtccgctcctccgccacccgggcctccgcgaccagctcggcggcccgcgcctccgcgtcctcctgtccgtgccgtgccgactcctccgcctcggcgaaatcccgccgggcctcggccaggcgggcctcggcgtaccgctccagctccgcgtggcgcgcctccagatccgcctcccgcgccgccagttcccgctcctgcgcctcccggcgctccgcctgctcctgctcgcgctccgcccgctccgcctccacccggcgccgcgtctgggccagcgcggccgccgcctgcgtccgccacgccgtcgcgtcctcccgcgcccccgcccgtacggcgtccgcctcgcgctgggcccgcagcagcccctgccgggcccggacctcggtctgctcgcgcaccgcctccgcgtcgccccgtgcgagttccgccgcccggtcggcgcgcgcctcggccgcgcccagcgtcgccgaggcgtccacccgcgcgtccgcccgtacggcgtccgcctcctcctccgccagcagcaggatccgccgggcccgctcgctcagctcgtcgtacgtctgcggtgccagcgcggacaccgcctcccgcagccgcgccgcctccgcctccatctgcttggccaggacggtcagccgtgccacccgttcccaggcctcgtcccggctccccgagagccgggcgagataccggtcgacctcttccatgcggtagccacgaccgcgcacggtcgcaatgggtgcactcatcctggatgcgcctctctcgcggggattcccgtcaaggatgcgccatttgatcccagaagccggaatggccgggccgagaccctgttcgagggtcccgacccggccatccggtcgatcacatgatcagccgatcagagcagtccgtcccacatctgctccagcagcaccgaccaccagctctccggcgaggacagcgccgcactgtcgagccccgccagattcgactggaagtcgaccgtccagcgccccgcctgctcgggcgtcagatgctggcgcagccgccacatgtggcccagcatcgccatcgagcgcacgaactgcggcaggctcgagttcacgaactgcggcggtacgggagcaccacccggcccgccttccaccggcaccgccacgatgttcgcggtcccgtactgcacacacagcgccttgccgaaatcgctgccgatcacgaggtacgagcccgcgtccgtcgccggctgcacctgccgctgcgccgccagctcggccagtgtcggcaccggctgccccggcaccgcctgcgcccagaagaacggcccgaaatcgacgggcaggcccgcccacatcagcgtctgcgccacgatctccggcacaccctgacgggacaccgcccgctggtcgaaacggaacacgccctgcggaccgaacgccgccgccagctcctgcccgatggcctccagcgggatcgccggctgcagcggaacctgcggcagcggcgcgcgcaccggcgcggggcgcgccggaccgtccgccacctggtgcagctccccctggtgggtgagcagatgccgcatgccctgctgacggcccgcgtggtccttgccgtacggggccacgctcgtgatccgcacctgcggccaggtctcccggatcatccgggcgcagtaaccgccgggcagctcacaggactccagctcggtgtgcagctccagcacctgctgcggcggcacgttcatggcgcgcagctcgtagaggatctgccactccgggtgcggggtaccgggcgccgagcggcggatgagctgctgctcggagccgtcgggcgcgcggtaccggagcacggcctggtagccggggccgacggtgggcgcaccggtcgggaccggcggctgccctccgggggcaccggggggaacgggcgcaccgggcggcggcccgggcggtcccaccggcgcgcccatggcgggaccggccagcatcgtggcggcatggtcgagcccgccgccgggggcaccgggcgcgccgggcggctgcggtacgccgggacccgcgagcatggtggcggcgtgatgggccccgccaccgggcgcacccggagcacccggagcacccggggcgccgggcggaccgggaggcgcgggcggctgacccgtgacggccggaccggccagcatcgtcgcggcatggtcgagcccacgacccagcgacccaggagcccccggcggaccaggaggcccgggaggctgcggcgcacccggagcaccgggcggacccggaggcgcgggcggctgacccgtgacggccggacccgccagcatcgtcgcggcatggtcgagcccacgacccagcgacccaggagcccccggagcccccggcggaccaggaggcccgggaggctgcggcgcacccggagcaccgggcggacccggaggcgcgggcggctgacccgtgacggccggacccgccagcatcgtcgcggcatggtcgagcccaccacccagcgacccaggagcccccggagcccccggcggaccgggcggcgtcgacggccggcccgcacccgggccggagccgcccggccgggagacctgggccttgctggtcggcgcgtcggcgatgtcactcgcccccgcaccgcccgcaggaccgcccggcgagcccagtgcgggcacgatcgcggtcctcggcagctggctgccgcccggcatcagcgtggtcttcgcctccggggccaccccggacgacggcgcgtcctccaggtccgacccggacagcggcggcgcgaacacggtcgcgggcagcggtacggacgcgtcgtccgtaccggagttcacatcggtgcccgcccagggcgtggcaccgatcggcacggcggccgcggccggagccgggggcggggtcggggtcgacgcggaaacaccgtcgttggccgtgggctcgtacgggatctcacccccgcgccgcagcggcacggcctcggccggagccggagcgggagccggcgcgggctcggacgaggacgaggcgacgggcgtgacatcggccggtgcggccggagccggtgcgggcgtcgacctcggcgcgatccccgcccggtccgcggcctcctgcagccactccggcgggctgagcatgaacgacgtctgctccgagtcgatccgcggcggcggaaccgaagcctccgaaacggccgcggccacggccccgtactcctcctcgtaccggcggatcacctcacccaccggcagccccggccacagcgtcacctccccgctgtcccgcgcgatgaccagccgctgccgcccaccaccggacaccggaccggccgcgcggtcctccgcccacaccacgaacccgagcccgaactcccgtacgcgcacctcccggtgctggtacgcgggcacgtccccgttgatccactcctcggcgcgctcctgcgcctgcgcaaaggtcaccatcgcgcgctcacccctccaccggtgccgaacccgacaccggaaccgaacgtgcgaatccgccgtccaccatcagaccggccaccgtctccagctccggcgggttcccggccagccgctcgagaaaggcgtcgaaatcagcaccgcacggcagcaacaaccgctccacgcgctcctggaccgaccagccgtcccggtcacgggcatcgtcgtacggggagaaccacaccgagccgatgccctcacccttgaccttcagcgcgagcagcccgccctgaacgaaggccacacacaggtagtccttggtcaggtggtcccgcagacacttgttgacgtacaccaggtcgttgaccgccgcctcctcacgcaccgtgaagaacggctggtccaccagcagaccgaggtccacgtccagccccgcgcccaccggcgcgcagccgcccgcggccttcaggaacgagcggtacgcctccggcagccggtagccgagatcctcctcgacgccctgcacctgctcctcggagaccgacaccaccgacttcggcagccccatgtgcgccgggcgcacctcctgcaacggccgcgtcccgcgcttgtcgtggtccaccggagccgtcgccaggcccgcgtggtgccgcagcagcgccttcacctcgaccggcaccagctccatccgccgcgaaccggccacgtggtgccaggtccagccgtgcggggtcgccaccggcccgaccgtgtcccagagctcgtgcccggcggccttcatcgccgcgttcgcggacacgcagtccgtgaggcgcaactcgtccacgccgaagccctccggcggctcggcgatctccacggccgcgcgcgcgtacgcggagaagtccggatgcccattgccgtccatccgcaccccgtgaggatgccgagcagcccggaccgggtccgggaagtgcacgacctgccccgagtaagcggcgttgggtggcgcggcctgctgcccgagccgacctgtcgtcatggcggtagccccctgctggatctggctggttcaccacagcctatgcgctggggcaagagcctcacccgcacccgaccggcgcacccgcccgagggccaggaacatccgaattgatacgaatattcgaccccgcttccgtatgacaggagacatttgacaggctgtccccgcagcacgggggcgtgagcgacagcggtcaccaccgccgccacgggagggaaagcgcgaccatgcacaacacggcaacacgcacagaatccggcgacaccgcgccggacgcaccaggcgcaccgggcgccgcgggcccggccggcgaagccaccggccccgccggcgacccccgcctgcgctggagcagcaccgacggccgccccgccgtgcccgtcctgcgcttccgccgcgacggcatcctccccaccgtcgccgccgccctctccgtacgcggcgaaaccctcaccggcaccgccggcaaagccgaccagccacccgcgctccacccgctcgtccaggacttcctcgacaccctcaccagcggccagcgcgaacgtttcaccggccggtgcccggaggcgatcctgctctcccgccatctcgccggcgtcgaaggagcccgctcccgacgcgcctcccgcaagcccctctcaccgagcgaggcccgccgctccctcaaacacgcgaagatcaccgcccggcacatccgggaggacggcgaccccctccacggcagctacgcaccgccctgccgctcctgcgacgcactcctcgcccacttcggcgtacgctccgtcgacctcaccccagccgagtagccatgaccaccgcctccgcttcctacgaccgctcctcggccacccgcttcccggtcgccgtggactccgccctgcgcaccgccggctgggaacccggccggtgggacatcaagcaggccgagtactgggccgacgccctccgggaccacaccacacccgccggacaccggcacaccgtcttccccgccgccgtcgaggcctgggccgagttcggcggcctgacggtcaccgcgcacggctccggccgccagatcgccccgacgcccgtccggatcgacccgctcaccggactccacctcgcccgcaccttcgccgacctcggccgggccctgtccacccagctctgcccgctgggcgtggaagccgacggcggctcccacctcgccctcgaccgcgagggccgcgtctacggcatcgaccacaccggcgactggtacctcggctccaacgtcgacgaggccctcaccctcctcctgaccggcctccagcccacccgcctcaccactgaccactaaccccgtcgccccgggcggcccggggtccgggcgtggtgcgggccgctccgcggggccgggcaggggtgtctcctcggctcgcgcctgcggcggggccggcccgtacggggtggttgcgcgctcgtcctgcggggacacccctgcccgtccccgctccccctgcgtcgggccgggcactgtcgaaggcctgccgtggggtggggacacggcggagtgtccccgcaggacgagcgcgcaacccaggccgacacagcaccacacggccgcaggcgcgagccgaggagacactccggcggggcaccaccccacaccaccagccccgccggcgattgaggcgcggggcccggggccgcacccccgaaaccaccgcccccggcaaccaccccccggccagggcccagcgcctagcgaaccggcaggaccgccgacaccttgaacccacccgcgtccgtcggcccggacacgaacaccccgcccaaccccagcacacgctcccgcatgccgacgagcccgttccccccgctcggcagccccggctccggagccttcccgtcacacggcccgttctccacctgcatggcgacttcctccgcccggtgcgcgagccgcaccacgacccgcgcacccggcgcgtgcttgtggcagttggtgagcgcctcctgcaccacgcggaacgccgtctgctcgacctccgccgcgtacgccgcccattcaccgtgcaccagcatctccacggccatccccgcctgccgggactggcccaccagcgcctccagctcgccgagcgagggcccctcctccccacccgccgcgaacgccgccgcctcgacggccggggcgggcaccggatccggcacggccggtttggacggcgcccggagcacgccgagcatctcgcgcagctccgtcaacgcctgccgccccatgtcccccaccagggccgcgttcttcgccgcccgtgcgggatccttgaccaccaccgcttccagcgcggccgcgtgcaccaccatcagcgacacccggtgcgcgaccacgtcgtgcatctcccgcgcgatccgcgtgcgctcctccgtacgggcccactcggcccgctcctccgcccggtccgccagcagcgacagctcccgttccagcgagtccgcgcgttcctgcaggctctccatcagccgccgccgggccccgatgtagagcccgaacagcaccggcggaacggtcagcgccaccgcgacgaacacggacagcacgaccacgagcgtcgcgtccgcctccacgtccccgcgggtgcgcaggtacatcacgacgaaggtcgcggccagcgagatcgaggccaacgcggccgtgatccgccgcggcacctccgaggaggccagcgtgtacatcccgaccaccgccagcaggaaccccattgcggccggcgagaccgcgatccccacgagcaccaccgcgatcggccaccgccgccgcagcacgagcgtggcccccaccacgaacccgaacagcgcgcccaccgccgccggcagccccacctcggcggcgaagagcacgccctcccacgcacactcgacggcggacaccccgccgagcaccacgtcccccacggcatcccgccgcctcgcccaccacaaaggcggcccggcgcggccttctacttcccccgttttggtcatgccgtccagcgtacgcagcgccccttgcgcgcggtcgaacgaaaatcccgagaaccgccggcaatcgaacgaagcgcccgaacgcgaaggacgacccctcatacgttccgcagggctcggttttgtaccgtcgcgtcgaaggcgcctggtgcggcatagtaggagccatcgactagatcaccaggcgagttgtccgattcagtcgaaaatagtcccctgtggtgtaattggcagcactgaggcttttggtgccttatgtccgggttcgagtcctggcgggggagctccatccttttcgggtcctgaccgtggcggtcgggacccgcgttcgttcggcgtcgccggcaccccggtatccttcacgggtccacccccgaagccgaagggcatccccgtgagcgccaaccgcccggcagccgtcgtcgtactcgcagcgggtgaaggcacccgcatgaagtcggcgactcccaaggttctccacgagatctgcgggcgctcgctcgtcggtcacgtcgtcgccgcctcccgtgagctcgaccccgagcacctcgtcgtggtcgtcgggcacgcccgggagcaggtcaccgcgcacctggccggcgtcgacgccgacgtccgcaccgccgtccagtacgagcagaacggcaccgggcacgccgtccggatggccctcgaagagctcggcggcgtcgtcaccggcaccgtgatcgtcgtctgcggcgacaccccgctgctgaccggggagaccctggccggcctcgcgcggacgcacgaggccgacggcaacgccgtcaccgtgctgaccgccgaggtcccggactccaccggctacgggcgtatcgtccgcgacgccggcggcgccgtgacggccatcgtcgagcacaaggacgccaccgacgcccagcgtgcgatccgcgagatcaactcgggcgtcttcgccttcgacggcgctctgctggccgacgcgctcggcaaggtgcgcaccgacaacagccagggcgaggagtacctcaccgacgtcctcggcatcctgcgcgaggccgggcaccgcgtgggcgcggccgtcggcagcgaccaccggcagatcctggggatcaacaaccgtgtgcagctcgccgaggcccgtgccctgctgaacgcgcgcctgctggagcgggccatgctcgcgggcgtgacggtcgtcgacccggccggcaccttcatcgacgtgaccgtcaccttcggccaggacgcgatcgtgcaccccggcacccagctgctgggtgccacgcacatcgcggagggcgccgaggtcggccccaactcccggctgaaggacacccacgtgggcgcgggcgcccgggtggacaacacggtcgccgagagcgcggtcgtgggtccgcaggcgagcgtgggtcccttcgcgtacctgcgcccgggcacgaacctcggcgcgaaggcgaaggccggtacgtacgtcgagatgaagaacgccacgatcggcgagggcaccaaggtcccccacctgtcgtacgtgggcgacgcgacgatcggcgagtacacgaacatcggtgccgcgagcgtcttcgtgaactacgacggtgagcacaagcaccacaccaccgtcggctcacattgcaagacgggttcggacaacatgtttgtggctcccgtcacgatcggggacggcgcctacacggccgccggatccgtgatcaccaaggatgtgccgcccggcgccctggccgtggcccgtggccagcagcggaatatcgagggctgggtggcccgtaagcgtccgggcagtgccgccgccacggcggcgcagtcggcggcctcggaggacgccgagcgcccttgaggtgaactgaccggaaacaggtacgcccgcgacggcgtaccgtgataggtgcacgcaattcggctggctcaccgtgtgcgggacggacgcacatgggggcgagcagcttcaacacgtctgaggagactgtgctgtgaccgggatcaagacgaccggcgagaagaagctgatgctcttctccggccgcgcccaccccgagctggccgaggaggttgcgcatcagctgggcgtcgccctcgtgccgaccaaggctttcgacttcgcgaacggcgagatctacgtccgcttccaggagtcggcgcgcggcgcggactgcttcctgatccagagccacacggctccgatcaacaagtggatcatggagcagctgatcatgatcgacgcgctgaagcgcgcgtcggcacgctccatcaccgtgatcgtcccgtcctacgggtacgcccgtcaggacaagaagcacaagggccgcgagccgatctcggcgcgcctggtggccgatctgctgaagaccgcgggtgcggaccgcatcctcacggtcgatctgcacacggaccagatccagggcttcttcgacggcccggtggaccacctgtcggccctgaacgtcctcgcggactacgtcggcgccaaggtggaccgtacgaagctcacgatcgtgtccccggacgccggccgtgtgcgtgtggccgaccgctggtgcgaccgtctggacgcgccgctggcgatcgtgcacaagcgccgcgacaaggacgtcgccaaccaggtgaccgtccacgaggtcgtcggtgaggtcaagggccgcgtctgcgtcctggtcgacgacatgatcgacaccggtggcaccatctgcgccgcggccgacgcgctgttcgcgcacggcgcggaggacgtcatcgtgacggccacgcacggcatcctgtcgggcccggcggccgatcgcctgaagaactccaaggtcagcgagttcgtcttcacgaacaccctgccggacccgtccgacctggagctcgacaagatcacggtgctgtcgatcgccccgatgatcgcgcgcgcggtccgcgaggtcttcgaggacggctcggtcacgagcctgttcgaggagcagcagtaaccgttccgcggtagatccttttggtgcggcctcccccgccgggtacactccatgagttgctcggcgagggaggccgtacctgttccggtacggatgctccgttatcgacgcgctcttcgtagcaggccgttccggccgggtgacttcagtccatttccgtcaccccacgaggagtgagcatgtccgaggtcaagctttccgccaagatccgtgacaccttcggcaagggctctgcccgccaggcccgtcgcgacgccctgacccccggtgtcatctacggtcacggcaccgccccgaagcacgtcaacgtcgacgcccactccctccagctggcgctgcgtaccccgaacgtcctgatctccctggacctgggcgacgcgggcaccgagctggtcatcccgaaggccgtgcagaagcacccgctgaagcgctcgatctcccacgtcgacttcctgatcgtcaagaagggcgagaaggtcaccgtcgacgtcgcgatcgtcaccgagggcgagctggccgccggcggcaacatgctggagaccctccagaacaccatctccgtcgaggccgaggccacgcacatcccgaccgaggtcaccgtctccatcgcgggcctcgaggccggtgcgaccatccacgcctcggacctggtcctcccggccggcaccaccctggccgtcgacggcgacatcgccgtcctgcaggtcgtggccccgcaggccgaggagccggccgccgaggccgccgagggcgaagaggcctgagcctcgccccaccccctcagcagttgctgaccgaccgccgtccggctccactggagcgggacggcggtcgtcttcgtagaggaaccgaggagcttttgatgtcggacgacgcggcaccctggctgatcgtgggcctggggaacccgggaccggagtacgcgggcaaccgccacaacatcgggttcatggtggccgacctgctggccgagcggatcggcgggaagttcaaggcgcacaaggcccgggcccaggtggtcgagggccggatgggtccgccggggccggcgaaccgccgggtggtgctggccaagccgatgacgtacatgaacctgtcgggtggtccggtgacggcgctgcgcgacttctacaaggtgccgctggagcggatcgtcgccgtccacgacgagctggacatcgactacccgacgctgcggctgaagctgggcggcggggacaacgggcacaacggcctgaagtcgatgaccaagtccatgggccccgactaccaccgggtgcggtgcgggatcgggcggccgccgggccggatgcaggtcgcggacttcgtgctgaaggacttctcgtccacggagcgcaaggagctggactggttcgtggaccgggccgcggactcggtggagtgcctgatccaggagggcctggagcgggcccagtccgcttacaactcctgacgggctacagctgctcgtcgacccgggtcagatcgatctccatccggaaggggacgtcggtcgtgaccacgccccgctgacgacgtacccctccaccggaggccgaggccacgttcgtcctatggtgcgatcctcgtcgctgccggatgcggcggagcccggtatccgtgtccgtcatcgcaaagggtgacggacacggataccggggctgcgcgtcagccggtgttgcgcaggcccgcggcgacgccgttgaccgtgaggagcagggcgcgggcgagcagcgggtcggcttcctcgccctgggcggccgcggcgcgctgacgggccagcagggagacctggaggtaggagatcgggtccaggtaggcgtcgcgtacggcgaaggtctgctggagcaccgggttcgagccgaggagttcttcggcgccggtgatgcgcaggacctcgcggacggtgagctcgtgctcggcctcgatgcgcgcgaagacgtgcttgaggtggtcgggcacgagggtgtcgacgtagtggcgggcgatccgcaggtcggtcttggccagcgtcatctcgacgttggacaggaagttgcggaagaagtgccagcgtccgcccatctcggcgaggacgtcctcctggccggcctcgcgcagggccttgaggccggagccgacgccgtaccagccggggacgatctggcgggactgggtccagccgaagacccacgggatggcgcgcaggccgtcgaggccggcgccggagtcggggcggcgggagggccgggagccgaggtggaggtcggcgagctggtcgacgggggtcgcggcgaagaagtacgagggcaggtccgggtcctcgacgagctcgcggtacgcggcgtgggcggcgtcggagacgacgtccatggcggcgtcccagcgggtgagggcctcgtcggactggcggggcgcggtgtgcagggcggaggcctgcagggtggccgcgacggtcagttcgaggttctcgcgggccagcgaggggaccaggtacttgtcggagatgacctcgccctgctcggtgaccttgatctcgccttcgagggtgccccagggctgggcgaggatcgcgtcgtgggaggggccgccgccgcggccgacggtgccgccgcggccgtggaagaggcgcaggcgcacgccgtagcggtgggcgacgtcgcggagccggcgctgggcgcggtggatctcccactgggaggtggtgatgccgccgaacttggaggagtcggagtagccgagcatgacctcctggacgtcgccgcgcagggagacgagccggcggtaggaggggtcggcgagcatctcgtcgaggatgacgtcggcggcgcgcagctcgtcggtggtctccaggagcgggacgatgccgatcttggcccagccggtgtggaggtcgatgaggccggcctcgcgggcgaggacggcggcggcgaagacgtcgtcggcgccctggcacatcgagatgatgtaggactcgatgacctcggggccgaacttctcgaaggcgtccttgatcgcgccgaagacgccgagggtcttggcgccggcggcgtcgagcggtgccggggtgggggccagcggacggcgggagcgcagttccttggcgaggagcttctgccggtactcgcggggcatgtcggcgtagcgccaggattcctcgccgagccggtcgaagagctggccgagggcgtggtggtgggcgtcggcgtgttcgcgtacgtccatggtcgcgagctggaggccgaaggcggcgagggtgcggatggtgcggtccatgcggccgtcggcgaagagtgcgccgcggtgttcgcgcagggaggtctggatgagggtgaggtcggtgagcagctcggcggtgccgaggtagtcgcggccctcctcgtgcgggatgcccttggcgaggcgctcgcgggtgttgaggagcttctgccggatgcaggtggccttgagccggtacggctcctcggcgttcagccgcttgtagcgcgggctgatctcggggaggcgttccaggtcggcctggagggaggcgaggagttcctcggtggctccggtgtagcggatggagttggagaggagtccgcgcaggtagtcgatgagttcgagggcgtcggtgatgccgtgctcgtgctggaggatcagcacgtcgcgggtgacctcgggggtgacgttggggttgccgtcgcggtcgccgccgatccaggtgccgaaggtcagcgggcgggtgccggcggggatctcgacgccgacgcgctggagctcggcggcgaggtcctcgaggacgtcgccgacggcgccggcgtggagctcgtcgaggtagtagatggcgttgcgggcctcgtcggcgggctcggggcgcacgacgcgcagttcgtcggtctgccagacgaggtcgatgttctcggcgaggcgcaggtcgtggcggcggcggtcgccggcgccggtgacgggctcctccagcagggtagcgatgcggcgcagcttgttgaggacgctgcggcgggccgcctcggtggggtgtgcggtgaagacggggcggacgttgaggttcttgaccgtctcgcgcaggtgttcggggtcggcgtccttcagcatgtcggcggtgcgggcgaggagcccgccttcggcggcacggtgggcgcgcagttccttgccgcggtgcacctgctcggtgacgttggcgaggtggaagtaggtggagaaggcgcgtacgagcttggcggcggtctccaggtcggtgtcgccgagcagggcggcggcggcctcgccgtcggtgcgggtgagggcgcggacgcgctcgacgagatcgaggaggtcctggccttcctggcgtacgagggtctccccgaggaggtcgccgaggcggcggatgtccgcgcgcagttccgcgttggcggtggcggccggggtgacgggggcctggccctggggggcctggtcagcactgctcacaggtgcggctccttgcagtgttcgagcgctactgggcggtgggctcccggcgacgtgcggtgatgcctgccccggattacgtccgggggcgggatctccgctcctgatgcgcagctcgggctgcccgtgcggaccgcgctgtccgacgggacacaggataggtgtccgaggcgtgtgcctgggcaaacgtctcatcaggcggcgcgtgaacacctcgcgcgcgctccttctcccggcgctgccccccttgcctgcggacccgcctttgccatacttacgatgccgtaggttacgggtccgtagggtttcgtaaccagggagcccgccgacttctctcaccccccaggggacacccatgaccaccagtcccgatctgatcgagggtggctccgcgccctccgacccgtccgagccgtccgcgacactgggcggcgagagcaagcgctccatcgagcagatcgccctgctgctgttcatcaccgtgcccttcgtggccgtgctggcggcggtgccgctggcgtggggctggggggtgagctggctggacctgggcctgatggtcttcatgtacttcctggcctgccacgggattaccatcggtttccaccgctacttcacgcacgggtccttcaaggcgaagcggccgctgcggatcgtgctcgcggtgatggggtcgatggcggtggagggtccgctggtgcgctgggtggcggaccaccgcaagcaccacaagttctcggaccacgagggtgacccgcattcgccgtggcggttcggggagacgctgccggccctgatgaaggggctgtggtgggcgcacatcgggtggctgttcgacgaggagcagaccgatcagcagaagtacgcccccgacctggtcaaggacccggcgatccgccggatctcgcgggacttcatcttctggacggtgttctcgctggcgatcccgccgctggtgggcggcctggtgacgatgtcgtggtggggcgcgttcacggcgttcttctgggggtccctggtgcgggtcgcgctgctgcaccacgtgacgtggtcgatcaactcgatctgccacgcggtgggcaagcggccgttcaagtcccgggaccgcagcgggaacgtgtggtggctggcggtgctgtcgtgcggggagtcctggcacaacctgcaccacgccgacccgacgtcggcgcggcacggtgtgctgcgcggccaggtcgactccagcgcccggctgatccgctggttcgagcagctgggctgggcgacggacgtccgctggccgtcggcggcccgcatcgacgcccggcgcagggaaaacgagtcgaacgcggcatgatggggggcgtggcgatcgacggcagtaattccagcagcgacaagcccaggcgcggccgccgggtacggatgacgggcgcggagcggcgccagcaactgctggacatcggccggaccctgttcgcggagaagggcttcgaaggcacctcggtggaggagatcgcggcgaaggccggggtgtccaagccggtggtgtacgagcacttcggcggcaaggaggggctgtacgcggtcgtcgtggaccgggagatgcgccagctgctggacggggtgacgggtgcgctgacggccgggcacccgcgggagctgctggagcaggcggcgttcgcgctgctggactacatcgagtcgtacacggacggattccggatcctcgtgcgggattcgccggtcgcgcagtcgacgggcacgttcgcgtcgctgatcagcgatatcgccactcaggtcgaggacatcctgggtctggagttcaaggcgcggggcttcgacccgaagctggcgccgctgtacgcgcaggcgctggtcgggatggtggcgctgaccgggcagtggtggctggacgtgcgccggcccaagaaggcggaggtggcggcgcacctggtgaacctggcctggcacgggctggacgggctggagtcgaagccgcagctggtgggccggcgcaagaactgagcgcggagtccgcggtacgacgacggcgccccgtcaccggagatccggtggcggggcgccgtcgtgcggtgcgtctcaggcgcagggttccggcgccgcgggttccgggtggtggcgttccaggaattcgagccggttgccgacggggtcttccgagtagaagcggcggtggcccggcaggttgtcgtcccagacgaccgtggccccccgctcccgcagtctgctcgcgtacgcctcgatgtcggtcaccctgagccccggatgggccttgcgggcgggccggaagtcctcttcgacgccgaggtgcagctggaccggaccggcggcgaaccagcagcccccgcgggcggcgaggacgggcggcttggggatctcggtcatgccgaggacgtcggtgtagtacgcgcggagccggtcctccgagtccggcggcgcggcgagttgtacgtggtcgacggcggtcagcacggtcatgcctccttgcgggctacggcgaagatgcggcggaacgggaagacggtgccgcgcgggccggtcgggtaggccgcgcgcagccggtcgcggtattcggtgaggaaggcgtccacggcgtcgcggtcgtcgccgagggcggtgaggacgggccgcagggcggtgcccttgacccagtcgagcacggggtcggggccctggagcagctggtggtaggtggtctcccagatgtcggcctcgcagccgagctcggtgaaccgggcgaggtattcggcgggttcgaggaggtggatgtaacgggcgccgtggccggcgagccgggaccgccagcgcggggtgtcgcactgctgcgcgaggagggcgtggctgggtgccgtgaagttgccggggatctggaaggcgaaggtgccgccggggcgcagtccgttgatccaggcaccgaaggagccggggtggttcgggacccactggagcgcggcgttggagacgatcaggtcgtagggctcctcgggcagccaggtggcgaggtcgccgtggcggaagtcgaggctgccgccgccgggcgtgggcccggcgtgctcctccccggcgcggtggagcatctcgggggagaggtcgaaaccggtgacgcgggcctcgggccagcgttcggtgaggagggtggtgacgttgccggggccgcagccgaggtcggcgatacgggcgggacggtgggggagctcgggtatgcgggtgagcaggtcgaggaagggccgtgtgcggtggcccgagtgccggaggtactgctggggatcccaggtgggggcggatggcgcggtggacgtgggggtcccggcgcgcgcggtatcggaatacatgttcgagcctccctgctggcggggcgatcggaagcggaatccgttccggccccctccatgccccatgctcgcttcatttatatctcgatgtcaagatactcgtgatcgagatactcggtatgaagagacttcacatcgacagaccccttacactgatcggcatggaggacgaggtcgaccgactggtggcggcatggcggcgggaacgccctgacctcgacgtggaaccgctcgaggtactgagccgcgtcagcaggctcgcgcgccacctcgaccgcgcccgcaggctggccttctccgagcacggcctggagccgtgggagttcgacgtcctgacctcgctgcgccgcgccggtgcgccctaccagctctcccccggccagctgttgacccagacgctggtcacctcgggcaccatgaccaaccgcatcgaccggctcgccaagaagggcctcgtcgaacggctcccggaccccagcgaccgccggggggtcctggtgcgactcacccccgagggccgggaccgcgccgaccaggcccttgccgggctgctggcccaggaacgggcgatcctggcccagctctcccagaaccagcgcggcgatctcgccgggctgctacgccagttgaccgctccgttcgacaacatccccggctaggtccgccggtcgtacgccggcccgccgggccagtgccaccgcggccagcgtggagtgcaccccgagcttgcccagcacgttctgcatgtgcgtgcggaccgtgtgcggggacaggaacagcctcgccgccacgtccttgcggcccagccccgccaccatgcagcgcagcacctcgtgttcgcgcggggtcagcgactccaccagccgttcgctgtccgtacggtgcttgcgcgccgccgtcagttcccggagcaccccggtgagcagggcgggcggcaggtgggtctcctcgcgcaggaccccgcggatcacggccagcagccgggagagcgagcagtccttcgccacccatcccgaggctcccgcctggagcgcgagggcggcccggcgggggtcgtcgcgctcggcgagcacgaccgtacggaccccggggtgggtcacccgcacccctgcgaccagcgcgatcccgtccgagccgggatgcggtggcccggagccggactcccgctgggcgggcacggcccccgggaccgcgccgagatcggcgtcgaccagcaggacgtcgaagcgccggccctcggccgccgcgcgttcgaggcagcgcagcgcggcggggccgctgccggccgcggacacgtccacgtccggctcggccgcgagcgcggctgcgagcgattcggcgaagatgcggtgatcgtcgacgacgagaacccggatacgaaccacaaaacccccaagggtaggggaacggacgacggcgggtacggcgcccggaccgggtgatccgcagctgccccggccgccgccgtgacatctctgcactaccccggaccggacgacgtacccgacttgtctcgacccctgaatcaacaccggcccccaccggtgtcacgcatcagcgtagggccgggggcgtccggcggttggccgaatagcagaagttttcctcgggattttccgacgcgggcgctgcgaaccggcttggcggtggcttgaaatcgcccgccccggaggtcctgatgacggcttcggtaccggcgtgtgccgcgggcagttgcacggggggcatttcacccggcgtgtgcacgccgggcgcccgcgcacggcgcccatccacagcgcacggccggaacgcacacgcccccgcaccggtcggggtgcggggggcgcgcagggcatgggcacggtccggacgagggcccggggcggacaccggaggtccgggaggcccaggaggttcaggaggcgtgcgtacgcgcgaagttccacgcgtccgtgatgatcccggtgaggtccgagcggctcggggtccagccgaggcgctcgtgggccgtgcgcgcggaggcgacgagcatcgccgggtcgccggcccggcgcggcgcgaccacctcggggatctcccggccggtgaccttgcggacggtctcgacgacctcgcggaccgagaagccgctgccgttgccgaggttgcagatcaggtgctccccgccggcggcgacccgcagggcggccaggtgggcctccgccaggtcggcgacgtggatgtagtcgcgtacgcaggtgccgtccggggtcgggtagtcctcgccgaacaccgagatcgactcccgctcgcccagcgcgacctggaggaccagcgggatcaggtgcgtctcgggggtgtggcgctcgccgaactgcccgtaggccccggccacgttgaagtagcgcagggacaccgcggccaggccgtgcgccacgcactcccccgcgatcatgtggtcgacggccagcttcgacgcgccgtacgggttggtcggcgcggtcaccgaggactcggtcagcaggccttccgtcggctccccgtaggtggcggcggtggaggagaacacgagcttgcgcacgcccgcgccgcgcatcgcggccagcagggccagcgtcccgccgacgttgttctcccagtacttgcccgggttcacgacggactcgccgacctgcgaggaggccgcgaagtgcagcaccgcctcgtaggaggagtccaggtggcgggcggcgtcctggatccggccctcgatgaaggcagcgccctgcgggaccccggcgcgaaagcccgtgctcaggtcgtcgaggacggtcacctcgtgcccggcctccagaaggtgggccgcgaccacgctgccgacgtatccggcgccaccggttaccaggtacttgctcactcgcctactgcctctcgcgggggagcacgcgcgggtgcgtgcgcgtgcttgggacactggcttacccgattccgcgcccacggggaaatccgagcccgccccggcccgtacgtcagccgtgcgcggcggccggcggcagcgtgggcagcgcccggtccagcagaccggtgcgggcggccagcgcggccgcctccagcctcgatcccacacccagcttcatcagcacccgctgcacgtgcgtacgggcggtgctcggggcgatctccatgcccgcggcgatcagccgggtgtcctcgccctcggcgacccggacgagcacctccacctcgcgcggggtgagcagccgcaggagccggctgccctcgtcgtcgggctgcgcggcggggttcaggagctccgcgaaggccccctgcagcagctgcggggcgatcgccacctcacccgccctggccttggccagggcccgctccacgccctcgatccgctcgtcctggcgtacgtaccccgaggcgccggcggcgaaggcggcggcgatcccgcgcgggctgggcaccgggccgaggacgaccacggcgatctgcgggcgctcccgcttgatgcgtacgacgggctcgaagaccccgggctcggcgggggtggcggtgccgaggaggcacacctccggcgcgcggctgatgaccagctcggcggcgcccgccgccggtgccgcggcggccagcacccggtggccgcgcagcttcagggcagaggccagtgcctcggccagcagccggtggtcgtcgaccaccacgacccgtacgcccatcgaggaaccacccttctgacccggcaagctacacgcttgttcgacggagcgcgggggataccgcgcagaagcccccgatcggtacggaccgttcgggggctttcggcggtgctgtgcgatatcggcgcgggtcgcgtcagctcgcggtgaaggagacgaagaggtagtccgggtcggccttggccgagtacggcttggagaccatcatgcgcgagatgaagaacttgcccttgtggtagcggtactcggagtagtcgggcgagaagccggtctcggcgcgctggctcgccttgtcctccgggttcgtcatgaggacggtctccttcatcgtcctgctgtcgatgctgacgatctggccgcccttgtcgtacggggggtacttgtaggcgatgatgttcgacccgtccatgcgcagcggcgacatcgtgaaccgctcgcccgcgtcggcgcggtcggtggtctgcttgccggtctccaggtcgaaggagagcagctcgttggtgcggccgctggaggtctggccctggtgctcgtacgacggcaggtagatcctgccgttgccgaccaccatgttcgagcacttctcgacctcggttccgcacttggcgccgaagtccccggaggcgagcgggatgcgggccttgagctcgcccttggggtcgacgacgaagaggtcgctgatgcccgtggcgttcttcgccgtcttgccgacgtcggcggcgacgatcaggggcttggtggcgacgatgttcgcgtcctcgatgcccggggagagcttgtacgaggcggtgggcgcgccggtggccgggtcgaggagctgcccgtagagcgtgtagttggggctctggccgcacttgcggatggcggcgagggcctcgcctccggcgtagccgacgtcgcggcagccttcgttgtcgatcttgggcagccacagggacttgccgtcggcgaggctccaggcggcgccgcccgcggagatgccggccgcggcgacggtgttgccgctgagggtgacgctggtgagggagacgggcttgtcaccgccggtggcgctcttggcgttgccggaccagacgagcttgccgctctccaggtcgaagacgccgacctcggtgcactggacgtacttgttctcgggcgtcggctgggcggccttgaagatgaccgctgccttgttgtcgctgacgtgcttgctggcgccgcagagctcgccggggaagggcagctcccacttcttgccgccgtcgacgaggttgtagccgacgaccttcgacaggtcggacttgatgtacgtggtgtcggtcagccaggagccggcgacgacggcgacatcggccgggaccgggctcggcacgttggccagcggcttcgacttcgtgttggcgggcgcctgctcggtgccgggcacgtagcccttggcgttgtcgccgctcggggaggcggcggtggggttgctgtcggccttgtcgtccccgccgccgctgtcgccggaggtgtaccagacgccgccgccgacgatgaggacgacggccaggagggccgcgccgacgatcgtcagctgggtgcgcttgtcgttgccggcgcgtgcggccgggggctggggggcgggcacgggcgggccgggaacaccgggggcgccgggcgcgccgtacgccggcggggggccgggctgctgcgggtagccgtagccgggcccggtctgcgggtagccgtacgcgggctgcgcgtccggtccgggcggcggcacgggcgctccgaacccgcccgggggcgggtcctgcggcgcgccgaagccgccggacggcggctggctggggggcggcgggatactcatcggttgctgttgcctctcggtgggcggctgctcggacgcgtgctcacttgccgaagaccatcaggagcttctcgtccttgtcctgggccgtcagccgggtcgtggagatgaggaaacggccgtccacgtagtcgaccttcggggagtagaaagtgctctcgatctgggcggagacgcccgaagggtggcgcaggagcgcggtgggcgtgccgccggcggccgggatcgagaggacctcgccgccttggtccgtctcggcccggcggtaggcgatcagctgcccgttcgcggccttgaggggcacgatggtgcgtgcttccccggccgggacgcgccacttggccttgccggtggccaggtcgaaggcgacgatctcgttggccttgccgaggtcggccttggtgggcaggtagagggtgcccgcgtcggcgacggcggtcgcgcagccctgcaggtcgtcgtcgtagctcacgctgcactcgggcgagaagttgccctcggcggtgagcgtggtgcgcttctggccgtcggggccgaggacgacgatggagtgctccttcgtcgtctcgtttccgaggtcgaggacgatcgggtcgaccgagtagacccggttgaccttccagcccttgggcaggcggttggtccaggtcttcttgccggtgaccgggtcggcgtcctggatctcgacggttccgtcggcgtcgtagcaggtggcgacggcgatcagcttgccgccgccggcggcgtagcggccgggcacgcagccctcggccgggctggcgaagagcttgtcaccggtgctgacgcggaaggcggtggcgcgggtgagccggttgaccgtgacggtgtccccggtcagggccaggtcggggtcgaggaagatgtcgaaggcgctctccttcgtcacctccttcgaccagccttccttgcccgccttgaggtcgatcatccggatctggttgcagtcggaggtgtccgtctcgccgttgcggtacatgacgacggtcttgccgtcgtcggtggtccggtcggtcatgccgcagatctctgcggggaagttgacggtccacttctctttgccgtcggcgaccgcgtagccggtgaccgtcttgccgacggacttggcgacggtgtcgccgacgacccactggcccttgctggccagcccggcgccggggccgtcgaccttgacggtcttgagccacaggaccttgtcctcgccctgcttgcggccggcgttgaggtccgtcggggccccgccgccgtcgccgttgccatcgcccttgtccacggacggggaccccgagggcttggcgtcggcgggctcctgcgccaccggctccggatccttgtcaccgcccgagaacgccacgtagccgacgcccccgagcacgagaacggcggccacggacgccgcgacgaccagaatcagcttcctccccggcgccttgcccggaccggggccgccgggacccacctggtgctgcggcacggtgggcggctgcggcggatagccgggctgctgggcgtacgggttctcaccctgcggcgcaaacccgtacccctgctgcggcggacccggcagatgcccgtaacccgaaggcgtcggcggctggttcggcggctggggcagctcggtcatcagcgcacgctttcggcatcggggaggtcggggaggatgacctttctatcactgacagcgctcatacatcgggccggtccgccccctgttcccaagggaggaccggcccgtgacgccgccgttatccggccagttgcccccggggcccggcggaatccggacctcctaggccgggccgcgcccggcgcgccgccaaatgcgcgcggaccgggaggagttcgcacggccctgcgccggggaccggcgcgcgctcacttgccgaagaccatgaggagcttctcctcctggccctgggcccgcagatgggtggaggagatgaagaaccgtccgtccgcgaactccagcttcgggagggtgaaggtgcgctcgacgggggccgcggggcccgaggggtggcgcaggagcgcggtcggggtgccgccgtcggccgggatggagatgacctcgccgccctgctcgcgctccgccttgcggtaggcgatcagctgcccgttcgcggccttgagcggggtcagggtgcgcttgtccccggccggggaacgccacttggccttgccggtggccaggtcgaaggcgacgatctcgttggccttgccggtgccggccgcggtgggcaggtagagggtgttcgcgtcgacgacggccgaggggcaggtcgccagggaccggaagaggccggtgtcgccgcagccgacggcgaagctgccctcgcccgcgagggtggcggtctgcttgccgtcgggtcccaggaccacgatggagcgctgcttcgtcttctcgtcgccgatgtcgatgacggtcgggttcaccgagtagatgctggtgaccttgaagttcgcggggagccggtaggcccagcccttcgcgccggtgacggggtcgatgccttggacctcggcggtggagtcctcgtccgagcaggtggcgagggcgatcatcctgccgttgccggcttcgtaggagtccgcgttgcagccgtcacccagggggttcgcgaagagcttgtcaccgttgctgatcttgaaggcgctggcggtgccgccgcggctgacggtgaccgtgtccccggtcatggacagggtggggctggtgaagatgtcgaagaccccttccgagggcacctccttcgaccagacctccttgcccgacctgaggtcgaccacgcgcagctggttgcaggaggtgttgtccccctcgccgtcgcggtacatgacgaccgtcctgccctcggccgtggtctgcggggcgacggagcagatctgcgcggggaaggggagcgtccacctctccttgccgtcggcgaccgcgtaggcggtgaggttcttccagaggctcttgacgacggtgtcgccggcgacccactgggcggcggcgtcgacgcccatgccggggccgtcgatcttgacggtcttgagccacaggaccttgtcctcgccctgcttgcggccggcgttgaggtccgtcggggccccgccgccgtcgccgttgccatcgcccttgtccacggacggggaccccgagggcttggcgtcggcgggctcctgcgccaccggctccggatccttgtcaccgcccgagaacgccacgtagccgacgcccccgagcacgagaacggcggccacggacgccgcgacgaccagaatcagcttcctccccggcgccttgcccggaccggggccgccggagccggtgccgccggggcccacctggtgctgcggcacggtgtgcggctgcggcggacagccgggctgctgggcgtacgggttctcaccctgcggcgcaaacccgtacccctgctgcggcggacccggcaggtgcccgtaacccgaaggcgtcggcggctggttcggcggctggggcagctcggtcatcagcgcacgctttcggcatcggggaggtcggggaggatgacctttctatcactgacggcgcccctgccccgggttgctcaggcctcctcggccagctccagccagcgcatctccagatcgtcgcggctcgcgaggagttcacgcagctccgcgtcgagcttggccaccttgtcgtagtcggtggagttctcggcgatctgggcgtgcaggctgccctcacggtcggacagcttgttcagctgccgctcgatcttctggagctccttcttcgcggcgcgcgagtcccccgaggcggtggacttcgcggcgcctgcggacgggacgggtgccggggcggccgcctcgatcatccgctgccggcgctccaggtactcgtccaggccgcgcggcagcatccgcaggctcgcgtctccgagcagcgccatcaccgtgtcggtggtgcgctcgatgaagaagcggtcgtgggagatcacgatcatcgagccgggccagccgtcgaggaggtcctccagctgggtcagggtctcgatgtcgaggtcgttggtgggctcgtcgaggaagaggacgttgggctcgtccatcagcaggcgcaggatctgcagccggcggcgctcaccgccggagaggtcgccgaccggcgtccactgcttctccttggtgaagccgaactgctcgcagagctggcccgccgtcatctcgcggcccttgccgaggtcgacgcggtcacggacgcgctggacggcctccaggacgcgcagggacgggtcgagttcgccgacctcctgcgagaggtaggccagcttgacggtctttccgacgatgaccttgcccgcggcgggctggacctcgccctgggtgcgggcggcctcggcgagggcccgcagcagggaggtcttgccggcgccgttgacgccgacgagaccgacgcggtcgccggggcccaggtgccaggtgaggtgcttgagcagttccttcggaccggcgtggacgctgacgtcttccaggtcgaagaccgtcttgccgaggcgggcgttggcgaaccgcatcagctcgctggtgtcgcgcggcggcggcacgtcggcgatgagctcgttggcggcctcgatgcggtagcgcggcttggaggtccgggccggggcgccgcggcgcagccaggccagctccttgcgcatcaggttctgccgcttggactcctcggtcgcggcgatgcggtcgcgctcggcgcgggcgaatacgtagtcgctgtagccgccctcgtactcgtgcacggcaccgcgctgcacgtcccacatgcgggtgcagacctggtcgaggaaccagcggtcgtgggtgacgcagacgagcgcggagcgccgttcctggaggtgcttggccagccaggagatgccctcgacgtcgaggtggttggtgggctcgtcgaggaccaggaggtcctggtcggcgatgagcagcttggcgagggcgatccggcggcgctcgccaccggagagcgggccgatcacggtgtcgaggccctggccgaagccgggcaggtcgaggccgccgaagagaccggtcaggacgtcacggatcttggcgttgccggcccactcgtggtcggccatgtccccgatgatctcgtggcggactgtcgcccgggggtcgagggagtcgtgctgggtgaggacgcccatctgcaggccgccggactgggtgacccggccggtgtcgggctcctccagcttggcgagcatccggatgagggtggtcttgccgtcgccgttgcggccgaccacgccgatccggtccccctcggacacgccgagggagatgccgtccagcagggtacgtgtgccgtacaccttgctgactgcctcgacattgaccagattgacggccatcagacgcgctccagggaaagggtgtggatcagctcctcagcgtaggccatgtccaaccctccgggccggggccgaccgttccacgaggtaccagccgcccagtgccatcgcgatcgcggccggcgcggtgacgggcagcgcgatcagcgtggcgctgtgcccgtcgagcagaccgccgaggccggtcatcgacaggcccaggatgccgagcaggcacagggtgatcccgacggcggcgacggggccgccggtgcgccgggcgggggcgggcgcgctcggccggggcgcctcgaagcggcggaacagcgcgacgaggagacccgtcagcacggccgcggccgccatccgtaccgggacctgcgcccaccaggcggccgtggcgggggccggcaggccgagaccgagggcgagctgggccgcgtacacaccgagcatcgcggtcaggtgccacaggaacgcggtcatggcgaggccgttggccgcgaccaccgcgcgccagacgcgcgggcggcgcagccacgcggtggcgggcccggccgccagctggacggcgccgacgagccacaggccgtggcagagcagggcgagggtgggcggggccatgttggagaccttctcgcccggcatcccgaccatggacagcgggtacgggccatacgccaccagcagggcggcgcaggcgagtccggcggcggcgaggacggcgggcctgcggatgcggccgtcggcgcgcaggaagccgagctggtggacggcgagccagacgaaggcgaagttcaggaactccacgtagggcaccccgagggcgaagcgcagtacgtcgaccagtgcggccgccccggccagcgcggcgaaggcggcccagccgtggcgctcgtgcagcttcagcaggggcggggtgaaggcgaccatcgcgaggtagatcccgatgaaccacagcggctgggtgaccagccgcagcgcggcccccgtgaggatgccgtccccgtgtccggcgagctgcacggcgagcgcggccgcggcccacaccaggacgaagacgagggtgggccgcagcaggcgctggagccgggcccgcaggaaggcggcgtagacgggcccgtcggtgcggcggtccagggagcggtaggagagcgcgtgcgagaacccgccgacgaagaagaagacgggcatgatctgcaggccccaggtgagcacctggagggccggtacgagggcgagcagattgcctatgccgtcgccgctgacggcggccatcagccagtgtccggcgatgacggtgccgagcgaggcgacgcgcagcaggtctacgtaccggtcgcgggcggcgggggtggcgtcggcgaggtcgcgtgcgctggctgtcatggggccacggtgtcccgcgccgggtgtctcccgacagggcgcggatactcaactccggcctgagtaccggcccggggctccgccccgaaccccgcgcaccttcagcctcgccggcgtttgaggcgcggggtccggggcggagccccggcagccggcccgcaggtcaggacggcaggaccgtggcacccggggcaggactggaggcaatccgcgtggcccggcaggtgcccgacgcggacagcgccgccgccaccttctccgcggcctccgcgtcccggcacaggaacgccgtcgtcggccccgagccggagaccagcgcggcgagcgcaccaccgtccacgcccgcggccagcgtcgcggccagcgacggccgcagcgacaacgccgccgcctggaggtcattggccagcaccgcggccagcgcttccgcgtcgcccgaggcgagggccgccagcagcgccggggaggcctccggctcggggatctccctgccttcggcctcggcgaggcggtcgaactcgcggaacaccgccggggtggacaggccgccgtcggccaccgcgaagacccagtggaacgtccccgccccgaccggcgtgagcagctcaccgcggccggtgccgagcgcggccccgccgacgaggctgaaggggacgtcgctgccgagctccgcgcagatgtcgaggagctcggtgagcggggtgtccaggccccacagggtgtcgcaggccagcagggccgccgcgccgtccgcgctgccgcccgccatgccgcccgccaccgggatgttcttcgcgatgtgcaggtggacggcgggttcgatcccggcccgggccgcgaggatctcggcggcgcgtgccgcgaggttggtgcggtccaggggcacctggtcggcgtcggggccggtgcacgtgatggtgagggcgtcggccggggtggcggtgacctcgtcgtacagggagacggcgaggaagacgttggccaggtcgtggaagccgtcggggcgggccgcgcccaccgccagccggacgttgaccttcgcggggacccgtacggtcacgggcgtgcggtgcgcgctcacagtgcgggcctctccgccgccggcttgtgctcggcgatcgccgcgaactcctcgaccgtcagggactccccgcgggcctgcggcgagacaccggcggcgaccagcgcggcctccgcgcccgccgccgatccggcccagccggccagcgcggcgcgcagcgtcttgcggcgctgcgcgaaggcggcgtcgacgaccgcgaagacctcggccttggtggcggtggtcttgatgggctcggtccggcgcaccagcgagacgagaccggagtcgacgttcggggcgggccagaagaccttgcggccgatggcgccggcgcgcttgacgtgcgcgtaccagttggccttgacggagggcacgccgtagaccttgttgcccggttcggcggccagccggtcggcgacctccgcctgcaccatcaccagggtccgctcgatggtcgggaagcggtcgagcatggtgagcaggacgggcacggccacgttgtacgggaggttcgcgacgagcgcggtcggcggcgggccgggcagctcggtcacgagcatcgcgtcggagtggaccagcgcgaagcggtccttcttcgcgggcatccgggcctcgatggtggcgggcagcgcgccggccaggatgtcgtcgatctcgacggcgacgacccggtcggcggcctccagcagtgcgagcgtcagcgagccgagccccgggccgacctcgacgacgacgtcgtccgggcggacctcggcggtgcgcacgatccggcgcaccgtgttggcgtcgatgacgaagttctgccccttctgcttcgtcgggcgtacgccgagggcggcggccagctccctgatgtcggccgggccgaggagggcgtcgggcgcggcgggggaggtgttctcggtgttatcgggctgctgctctgcggtgctcaccggtaaagcgtctcagatcggccgagcgatcccgcgccggaccgggctcactacgacgtgagcctgcggccgcagtgcggccacgggctcgccccccgctgcacgtagagcttcttcgcccggtacgtctgttccgtgcccgaggcgtcctgcgggcgtccgctcccgccgaggctgtgccaggtgcggacgtcgaactggtacagcccgccgtacgtcccggaggcgtcggtggcggcggggcggccgccggactcgcactgggcgagggccgcccagttgaggccgtcggcgccggcgacggagctgggcagcgatctggtgccgaccttgacgagctgggtgacgggttcgcggacgacctcgtcggcgatgggtcggggcttctgccggaccccgttgacggtgcgcaggctgtacgtgaccctgcgcgccccggggcggccgacgcgctcgacgacttcggtgccggtgaacagggtggggtcctcgaccttctcggtcgcgtacgggatgcgctcctcgcggacctcgcgggtgccggtgatgcggagcacggtgacggtctggccgtcgcgcgggaactcggtgggcggcacggaggtggtgtcctggccctggagggtgatgcccgcctggtcgagggcttccccgacggtggcggcgttggtgcggatggtgcgttcgcggccgtcggccatgaaggtgacgctgcgttcggtacggacgctgagggccaggcccgcccgcgggacgggggcggtgcggggcgtcgagaggtaggcgccctcggcgcggatgccgaactggcgcagggcgccctcgacggtgcgggcggtggtccacacctggcgctgctgcccgtcgagggtcaggcgcagggggcggccgtagcggacgacgatctcctcgccgtcctccaggggttggccgggggcgggggcgacgaggtcgtgggggccgacgccgaggccttcggcggcgagcagttcgccgatgtcgtcggcgaaggtgtggaggttgcgcgggactccgtccacggtgagccgtacggccttgtcggcggcgacgaacgccgtggtgccgccggcgaggaaggcgacgacgagggcctgcggcacgatgcgccgccagttcccgccgagggtctcgacgggggtgcggccgcgggcgcggcggcggccgggcaccgcgggagcgggggcgattgcaggctcgactgcgggggcgacggcgggggcgctcgcgatggcgtcggccggtggtgcggccacgggggccgcggcccggcggcggcccgggcccggcgcgacgggcgtggcggccagggtgtcggcctccgacagctcggccggtgagaggtcggcccggcggcggcgcccgccgcgcggggccgggaccggggtcggtgccgggaccggggtcggtgccgggaccggggccggggccgggacgaccggggccgcgaccgggaggaccgggggcggggccgggaggaccgggggcggggccggggccgcgggctccgggttccaggcggcgggcgacccgggaccgcccgtaccgtccggccaggccgcgccggacaaggatggggcctcgtacgcctcggggacgggaccgccacggcggtgactgccctgcgtatcgctcacgacgctcgctccactggtgatccggcaccctccggtgcgggcacggcaccctagcggaggagtcgtcacgctccaaagcggaacgacaacccagcgtgtcggagcgggcgcgggatcagtagtcgaaggcgcgggccgtgttggccgccagggcgctggccatcgcgtcctcgtcgatgccgcggaccgcggccatcgcccggaccgtcagcggaatgaggtacggggcgttgggccgaccgcggtacggcgcgggggtgaggtagggggcgtcggtctcgacgagcaccagctccagcggggccacggcgagggcgtcgcgcagcggctgggcgttcttgaaggtgacggtcccggcgaaggacatgtagtagccggcggcggcgcactcacgggccatgtcggcgtccccggagtagcagtggaaaatcgtccgctcgggggcgccctcctcgcgcaggacgcgcaggacgtcggcgtgggcgtcccggtcgtggatgaccagggccttgccctgccgcttggcgatctcgatgtgcgcgcggaaggaacgctcctgcgcggccatgccctcgggcccggtacggaagtggtcgaggccggtctcgccgaccgccttcacgtggtccagcgcggccagtgcctcgatctcggcgagcgcctcgtccagcgccgcctcgccgccgccggggcgggcgccctggcgcgaccagccgtcggggtcgccgaggacgatccggggcgcttcgttcgggtgaagggcgacggccgcgtggacgttcgcgtacgcggccgcggtctcggcggcccacctggagcccttcacgtcgcagccgacctggacgacggtggtcacgcccaccgaggcggccttcgcgaggccctcctcgacggtgcccgcctgcatgtcgaggtgggtgtgcgagtccgccaccgccacccggaggggttcgggcagcggcggcggtgcgtccttggaagcagcggaagggctcatacggccgatcttatgaccggtggaagagtcccttgagacgggagagcagaccccggcgctcccctgcgggggcgacggccgccggccccgaggaggcgggcgaccgggagggcttgcgcggcttcggcgtccgggggacgttcgcgccggccgggacgggtccggcgatcccgggggcgatctggtggtggtagatgtggtcgatcatgcccatcaccgaggagacctggccggcccgcatgatgcgtacgacgtgtccgccgcagttcaggcaggtcgggttggacaggggggagggcacccgctcgccgttgaccatgtacatgatgaacggctcgcccttgccgtcgacgtggtgctcgatggcgtacgcctgctcccagccgtacccgcacctcatgcacgcgaaggagtaggcctcgtgcacggtgtgcacgtcggaagcggtcacagcgacagggactgcggcggggacgggtaccggggtgtctgcgatctcactcatgccagctcctcttgttccactggtgccattgccagtggacgcctcaacgggcgggagcgcatcaggccctgtctactgttggacggtctttgggcgactcatgcccaaagcgcccggtgcgcggtctgagctttgcttttcaggctagctctttaccgaccggcggcaccttttgtgccgcgttctttgccgcgaccacagcgtcgaacacctcgcgcttgggtacgcccgcctcggccgcgaccgccgcgatggcctccttgcgccgctcaccggcctcctcgcgcacccgcacacggcgcaccagttcctcgtcgtccacgtcgccgggcacggccgccggggcgccctcgaccacgacggtgatctccccgcggaccccttcggcggcccaggccgctagctcgccgagcccgccgcgcttgacctcctcgtaggtcttcgtcagctcgcggcagaccgcggcccgccggccggcgccgaagacctcggccatggcggccagggtgtcgtcgagccggtgcggggcctcgaagtagacgagcgtgcgccgctcgccctcgacctcgcgcagccggctcaggcgctcccccgccttgcgcggcaggaacccctcgaagcagaaccggtccaccggcagtccggacatggcgagcgcggtgagcaccgcggacggccccgggacggcggtgaccttgatgtccttctccacggcggcggcgaccagccggtagccggggtcggagaccgagggcatgcccgcgtccgtcaccagcaggacgcgcgccccgccggccagcgcctcgacgagctcgggggtgcgcgccgactcgttgccctcgaagtacgacagcacgcgcccggtggtgtgcacaccgagtccctgggtcagccggcgcagccgccgggtgtcctcggcggcgatcacatcggcccgttccagctcggccgccagccgcggcggagcgtccgcgagatcgccgatgggggtgccggcgagcacgagcgtgcccgtcaggcctccggccgtggctgctgtcgtggtggcttcggtaccgcggggctggtcagtcgtcacccgcccatcctctcagccccgtggcccgccgccccccgccgctggtggcacacacagatctcttccctacgatgtgccggtgaccagtaccgcgacgccgccgcccagccccgcgggggccccgcccgcctcaccggctggccgcgaagacgagccgcccacctggctgcgccggctgcgcggcttcggctacgtgccgtccgccgccgcttccgcgcgcgcggacgtccgcacccgcctggtgcccccgtacgccaggccgtcccggcagatgtggatgaccttcgggctgccgccccaggtgtgggggacctggcagctgatcgtgtcgtgggtggggccgctgctggtggcactggtcgccggggtgctgcggttcgtgcacctgggcagcccgaaggcggtgatattcgacgagacgtactacgccaaggacgcctgggccacgatcaagcaggggtacgaggcgagctggcccaaggacatcgacgcgtcgatcctcgccaacccggccggggtggccctgccgtcggacccgggctacgtcgtgcacccgcccgtcggcaaatgggtgatcgggctcggcgagtggatgttcggcttcacgccgttcggctggcggttcatgaccgccgtgctcggcaccctgtcggtgctgatgctgtgccggatcgggcgccgcctcttccgctcgacgttcctgggctgcctggcgggcgccctgctcgcggtggacggcctgcacctggtgatgagccgcaccgcgctgctggacctggtgctgatgttcttcgtgctcgccgccttcggggccctgctcatcgaccgtgaccgggccagagcccggctcgcggacgcgctgccggtggacgaggagggccggacccggcccgacgcgaagatcgccgaaacgctgcggctgggctggcggccgtaccggatcctggccggtgtctgcctgggcctcgccgcgggcacgaagtggaacggcttcgtcgtcctcgccttcttcggcgtcctcaccgtgctgtgggacgccgccgcgcggcgcaccgcgggcgcgggcgccccgtacgcctcgatgctgcgccgcgacgcgctgcccgccttcgtctccaccgtcccggtcgcgatcgtgacgtacgtggcctcgtggtcgggctggatcctcagcgcggacgacggcaagggcggctatctgcgcgactgggcggccaagtacgaccagggcagttcgctggggttcctgccggagtggctgcgcagcctgtggcactacgagaccgaggtctacaagttccacgtcggcctgacctcgggccacacctacgagtccaacccgtggagctggctggtcctgggccggcccgtctcctacttctacgagtcccccgaacccggcgccgacggctgcccggcgaccgcggcgggcaagtgcgcccgcgaggtcctggccctgggcaccccgctgctgtggtgggcgggctgcttcgcgctgctgtacgtgctgtggcggtggttcttccgccgcgactggcgggcgggcgcgatcgcgtgcgcgctggcggcgggtctgctgccctggttcaactaccaggagcggacgatcttctacttctacgcggtcgtcttcgtcccgtacctgtgcctggcggtggcgatgatgatcggcgccctgctgggccccgccgggtcgtccgagcgccgcaggacgctgggcgcgatcggcgcgggggtgctggtcctgctgatcgcgtggaacttcatctacttctggcccatctacacgggccagaccctcccgatggactcctggcgcggccgcatgtggctggacacctgggtctagcagcacaaacgacgggcccggcacctggtggcgccgggcccggcgtcgtctccgctaccgggacgcctcgcaggccgactgcgcgacgtccttgctcgcgccggccgcgacgaggctggagtcgcagctggtctggttgccgatcgcgccctggtagcaggcctccgcgacgccgtccttgaccttggagtcgtgcttggcgacgtactgctcgcaggccagtacgtccgcgtgggcggacggggcgacgacgacggcgccgccgacggcgagggccaggcctgccaggatgctggggatacgagccgacggacgcatgcggatgcacctgctctctcggtgggtcacgcggtccgccgacgcgccggaccgcgggcgggggcggcggctcggagcgggcactccggggggcgaccggctcgacgcagcggtcaccctcgcccttccgacgctagaacaaggcgccggagcacgcactttcgcgcgcggcgtcagcgctccggcgcgggctcgtcgtcccacgtggggaccgtggtcgtaccggcgtcccggtcccgccgcaggatcgcgtacccgaccgcgtcgtggaccgttccgtcggccgagggccagccctcccggtagtgcgcctccttgacgtacccgcaccgccggaaggtgcggcgcatcgccgcgttgtcctggcgcgtggtgccctcgatccgccggatccgcgggagttcggtgaacaggtattccgtcagccaggtcagcgcgtgcccgccgatcccccggccccggtaccgggcgcggatgcgcaggtcgaagacgggggtgccgtcgcccaggtccatcaggcggaccaggccgagggtgtcgccgccgccggtgatccagaacgacctggtctccgcgttgtcgaagcggccctgcgcggcccatcgccgggcctcctccgggtcgaccacggccgagccgtggaacggccaggtgtccccggtgaggaaggcgaccaggtcatcggcgtcggcatcggcgtagcggcggtaggtgaggtccacggcggcactctagggggtggcttgtcgatcagggcggatcagggagcggtgccgggcgccgcgagcccgccctgatcggcaagccaccccctggggatggtggccggcggcgacgagtggattacgttccgatgttccggtccggtaacaacggcgtaccggagcgctgcgcagagtaaagtccgcaccaagggttcttgaacgcgttcaggaaccgcgaacatgggggaaggactcgaatgcacggggcagcgaaaggtgccgtcatcggcggggtgttcctcgcgatgctcggcggcgccgggtacggggtgtacgcgctggtcggcgatgccggcggagacgggcaggaaggcaaggacggcgagacctccgtccaggccgagaagggcagcgggccggtcagcgagaaggacgccgcaaagaccgccaaggccttcctggccgcctgggcggccggggacgagcgggtggccgccgacctgacgaacaacgccgcggccgcgcaggccgcggtcggggacttcaagaccaagtcgtacgtgtccaaggccgtgatcacccccggcacgccgaacggcaccgtcgtgccgttcaaggtcgaggcggagatcacgtacgagggcacgaccaagccgctggcctacgactcccagctgaccgtggtgcgtgggctgaacagcgggaagccgctggtcgactggcagccctcggtgatccacccgcagctccagaaggacgagaagctgcgcgcgggcgctcccgcgaacccgcccgtcaaggcggtcgaccgcaacggagaggagctgaccgcggagaagtacccctcgctgcgtcaggtcctggacgaactgcgccagaactacggcagcaagacgggcggcaaggcgggggccgagctgtggatcgaaccggccgccaaggacgctcccaagcggacgttgctgaccctcgtcgagggcgagcccagcgtcctcaagacgtacctggacgcgaaggtgcaggcggtggccgagcaggcggtcgccaagttcccggaggcctcggtggtcgccgtccagccgagcaacgggcacatcctggccgtcgcgaacaaccgcaaggacggcttcaacgcggcgatgcggggcacccgggcgcccggatccacgatgaagatcgtgacggcggcgatgctgatggaccgcggcctggtcgccgcggacaagccggcggagtgcgggaagaccgtgacctggggccgtgagttccacaacctggacaacttcgacctgccgcccggcaccaacttcgcgacctcgttcgcccgctcctgcaacaccgccttcatcaagcagatcaagccggtcaacgacgactccgcgctgccgaaggaggccacggaggtcttcggcatcgacctggactggaagaccggcatcaagtccaccgacggcaaggtcccgccggccacgggcgcggcggcggccgccgagtacatcggccagggccagatcaccatgaacccgctgaacgtcgcgtccatcaccgcgacggcccgcaccggcgtcttccgccagccggtgctggtctcgccggagctcgacggccgcaagctcgcgacggccgagcgccggatgaagtcctcggtgcagcagcagctggtcggcatgatgaagctgacggcctccagcggcaccgcgcagaaggcgatggcctcggtccacggctcggacaagggcgcgaagaccggctcggcggaggtcggcggtgccggggagagcccggacagctggttcaccggcttcagcggtgacgtggccgcggcggccatggtcgagggcggcggccacggcggcgaggcggcgggtccgatcgtcgcccaggtgctgaacgcgggctgacgcgggccgaaggcgggccgcccggtgtcggcgacgcgaccagccgggccgaatcgcggtcgcgtcgccgggccgcgccgcgttagcgtcgcggcatgacgacctccacgcaccccctgttcgccgaggccctggccgggctgggcctcgacctcaccgtccggagctttcccgaagggacccgtacggccgccgacgcggcggccgcgatcggctgcgagctgagccagatcgtcaagtcgctgatcttcgcggcggacggggtcccggtgctggtcctcatggacggggcctcgcgggtggacgtggaggccgtacgccgcgaactcggcgcgcagaaggtgacgcgggccgacgccgccctggtccgggaaaccacgggctacgcgatcggcggggtccctcccttcgggcaccgcacgcgcacccgggtgctggccgaccggtcgctgctgtcccaccaggagatctgggcggcggccggcaccccgaccacggtgttcccgatggctccggaggagctcatcgcgcacgcgggagcggtgctggccgacgtgcgcgagcggccctcggagggctgacgggccgtgcccgggaagccggcggggacgcgctcggacgggccgtgcccggagcgccgacgggcccctcagcgggctgacagagccggcttcagggccctgaccagggcctgtgcccgggggtccgcggtgaccgacttggcgagggcgttggtgacgtagccgaagccgatgccggcctccgggtccgcgaaggccagggaaccgccccggccggggtgcccgaaggaggccggcgagagcagcggggaagccgggccgtgcagcatgtagccggggccgaagcgggtgttgacgaccagcacccggtcgggcccggcggagtgctcccgggcggccagggcggtggtggccggggtgaagatccgcgcgccgtcctcgaccacgccgatggtggccccgtagaaacgggccagggcccgggccgtgccgatgccgttcgaggcggggagctcggcggcccggtaggcgggggcgttctcgtcgggcagcggttcgatggcggcgaaggcacggcgggtgagggattccgggtcggcgtaggcctcggagacgttgcgccgcggccgggtccgcagcatgcccgcgctctcgggcggctcgaccggtgccacccggcccgcacggtgggcctcggtctccggcaggccgatccagaagtccagcccgagcggttcggcgatctcctccgccaggacgcagcccagggtgcggccggtcgcccgcagcaccagctcggacagcagccagctgtaggtctgcgcgtggtagccgtgctcggtgcccggctcccagaagggccgctgcgcggcgaccgcgcgcgccccggacaccccgtcggcggcctcggcggcgctcagcccccggtccagcgccggtatgcccgcgcggtgcgcgaggacgtcgcggaccaggatccgctccttgccgcccgtcttgaactccggccagtacgagcccacgggcgcgtccaggtccaggagtccgcgctggtgtagcagcagcggcacggcggcggccacgcccttggtggcggagcggacgatctgcgcggtgtccccggtccagggctcggcgccgtccgcgtccttcgtgccgccccacaggtcgaccaccttgcggccgtcgcggtagacggccacggccgcgccccggtccccgagcacctcgaagttgcgtacgaacgcgtccctgacgggctcgaagccctccgccaccgtcccgtggacatccacgtcttcgctcccagcacctgcgcacctgccgcggcgccccgacggcgcccgcgcctacgtcaggatgcaacgccggccggacgcccttgcttcccgggtcccccggatcccgtgcggcgccccgccgccggtcagtgcgaggggcgcgtcagaaggggcgtgctggggtcgaagccgaacgggagctccagccggtgggcccgcatcagggcgtcgtcgcacaggagctcctgggtgcggccgtccgccacgatgaccccctcgctgaggatcaccgagcgcgggcacagttccagcgcgtacggcaggtcgtgcgtcaccatcaggacggtcacgtccagcgagcgcaggatgtccgcgagctcgcggcgcgaggccgggtccagattggacgagggctcgtccaggaccaggatctcgggccgcatggccagtacggtcgccaccgcgacgcggcggcgctggccgaaggagaggtggtgcggcggccggtcggcgaagtccgccatgccgacctggtccagggccgcccggacccgctcctccagctcggctccgcgcattccggccgcggccgggccgaaggccacgtcctcgcgcacggtcggcatgaacagctggtcgtcggggtcctggaagacgatcccgacccggcggcggatctcggcgaggttgcgcttctccaccggcagcccggccacggccaccgagccgaccccgccggtgaggatgccgttgaggtgcagcacgagcgtggtcttgcccgcgccgttgggtccgagcagggcgacccgctcgccctgcccgacggtgaggtccaccccgaacagggcctggtggccgtccgggtaggcgtaggcgaggccgccgacttcgagggagggggtactggtcacagggtccatcccatcagacagacggcgagcgccgtcaccgggagcacggccgagtacgcccactgggcccgggtcgccgcgacctcgtcgatgaccggcatcgagccggcgtagccgcggctgaccatcgccaggtagacccgctcgccccgctcgtaggagcggatgaacagcgcgccggcggtcttggccagcaccccccagtgccggatgccgctcgcctcgaagccgcgggagcggcgggcgatggacatccggcgcagctcgtcgctgatcacatcgccgtagcggatcatgaaggaggcgatctggacgagcagcggcggcagcttcagccgttgcagacccagcagcagggcgcgcagctcggtcgtcgaggcgagcaggacggacgcggcgacgccgagggtccccttggcgaggacgttccaggcgccccagaggcccgagacgctgagggacatgccgagcacctgcacccgctcgccctcggccacgaagggcatgagcacggcaaaggcgacgaagggcacctcgatcagcaggcgccggagcaggaagccggccgggatccgcgcgacggcggccaccagcgcgacgaggacggcgtacaggccgaaggcccacaccgcctcgcgcggtgtggacacgacgaccacgacgaaggccagggtcgcggcgagcttgcagtgcgcgggcaggtcgtggaccggcgagtggccgtggcggtagagcttgtgggcgtggcctgcccccacgtcagcccgccgagacggaggtggaggcggcggtcaggtcctcggtccggcggcggcgcacggcccagaagatcccggtgccggcgacgacggtcacgccgacgccgatgaccccggcgaggccgccggacaggcgggcgtcgccgacgtccttgacgctgtagtcggcgaggggggagttcgcggcggcgtgctcctcgaccttctcgtcgatgcccttgtctgcggcgaccttctccaggccgtcggggttcgcggaggcgtagaaggagacgaacccggcgagtacgagggcggtgaccaggccggtcacccagactttcttcgtggatccggcgccggaggccgcgcgggcgggggccgcggccgggaccggcgcgtcgacgagcgcgccgtcgacgcgcagcttgagggccgaggtcagcccgcgggccccgtgcaccaggtcgggacgtacggcgatcacggcacccacggtggccgcggtgatggcggcctcgcctatgccgatgagcacgtgcacgccgaccatggcggtgatcaccttggcgacgggtacgtcggtggtgccgccgatggcgtagacgagggtgaaggcggcggccgcggcgggcaccgagagcagggctccggtgaaggcggccacggtcacggagcgccgggtgggcggcaggatcccgagcagcccgcggaagatcgcgtaggagacgacgacggtgacgacgcccatgacggtgatgttcacgccgagggcggtcaggccgccgtcggcgaagaggatgccctgcatgagcaggacgacggacacgcacagcacgcccgtgtaggggccgacgagtatcgcggcgagcgccccgcccagcagatggccgctggtgccggccgcgacggggaagttcagcatctggacggcgaagatgaaggcggcgacgagaccggcgagcggcgcggtgcgctcgtcgagctcgcggcgggcgccgcggaggctgacggccaccgcggtggcggcgaccactccggcggccaccgacacgggcgcgttgatgaatccgtcgggcacatgcatggagtggctccgcttcttactcagtctttagctgttcaaccatagtgcccagttgcaaaccattggcaagagcggccgcatcacaaatagagccgcgcgatttcgtgggaatgtgcgaggctggacgggacaaacggacgcaaatgttccgatttcgaggagtcttgtcgatgtcagccaccgccgagaatccaccagtgaccgccaccgcgagcgtcgtcgaggagcgggtacgcgcccgcgtgatcacggacgatcccctctaccggacgatccccgtcgccctgcgcttcgccgcctccgagccgctggccgtacggatcgtcttcccggcagggctgtcccccgagggcaccgacaacgaatgggtcttcccccgggccctcctggaggccggcctccaggctccgaccgggaccggggacgtacgcatctggccctgcggccgcgtccaggcggtcgtcgagttccactctcccgagggcgtcgcggtcgtccagttcgacatcgccgcgctgcgccggttcctgcgccgcacctacgcccccgccgtctcggccgtctccgccgtctcggccgccacccgtcaggcctaacgcacccggccccgtaccgcccggcgatcgggcgggtacggggccggggtcgtcccgcgggtccggcggacccgcggggtcaggcgttgaccagctcgcggtccttgtccgggccctccggggagtccgcggaccgctccaggtgcttgcgcaggctctcgccctccacgtccacgttcggcagcagccggtccagccacttcggcagccaccaggccttgtgcccgagcagggcgagcaccgccgggacgatggccatgcggaccacgaaggcgtcgaagaagacggcgacggccagaccgaagccgatcatcttgaccatctgctcgctggccccgatgaagcccgagaacaccgcgatcatgatgacggcggcggccacgacgacccgcgcgctgtactggaagccggtcaccacggcctggcccgggcgctcgccgtggacgtacgcctcgcgcatgcgggtgacgaggaagacctcgtagtccatggccagaccgaagacgacacccaccatgaagatcggcatcatcgacatgatcggaccggtctgctccactccgaagaccgagccgagccagccccactggaagaccgcgacgacggcgcccagtgcggcgacgaccgagagcaggaagccgagggccgccttgagcgggaccaggaccgagcggaagacgagcatcagcagcaggaaggccaggccgacgacgagcgccaggtagggcagcagcgcgtcgttcatcttctgcgagaagtcgatgttcatcgcggtggcgccggtgacgaggacgtcgtccccgctgccgtcacggatctcgtggaccaggtcctcggtgtggacggaggacggtcggtccttcgggatgacggtgatcaccgcggcgtcgccggcctcgttgagggtcggcggggtgaccgcgaccacgccttccagacccttgatgcggtcgaccgtggtgtcggcgagtgccttgtcgccgtcgacgaccaccatcagcgggccgttgaagcccgggccgaagccgtcggacagcaggtcgtacgcctggcgctgggtggtggagaccggctgggcgccgtcgtccggcaggcccatctccagcttgctcgccgggacggcgatgacgccgaggccgatcacaccggccagcagcaccatgacggggcggcgcaggacgaaacgggcccagcgggtgccgccgttggccttcttctcggcgcccgccggcttgcccttgccgaacagccggctcttctcgcccgcgggcagcaccctcttgcccgcgaaggcgaggatggccgggaccagggtcagcgcgaccagcacggcgatgaccacggtgcccgctgccgcgaagcccatcttggtcagcatggggaggttgacgacggccaggcccaccagggcgatgaccacggtcagaccggcgaagacgacggcggagccggcggtaccgaccgcgcggccggcggcctcgtcccgctcacggccctcggcgagctccacgcggtagcgggagacgatgaagagggcgtagtcgatgccgaccgcgagaccgatcatcgtcgcgagggtggcggtggtgttgccgaggtccagcacgttggcgagcgcggtgatggaggagacgccgatgcccacgccgatgatcgcggtcagcagcggcagaccggcggcgatcagcgagccgaaggtgatgaccaggacgatcgcggcgaccgcgatgccgatgatctcgccggagcccgtctcgggggccgccatcagcgcgtcgccgccgatctggacgttcaggcccgcggccttggcgccctcaccggagtccttgagcgcctcgcgggtgtcgtccttgagctccatgccgctgactttgtacttggcgctgatgtaggcggtggagccgtcctggctcacggcctgcgcctcgtacgggtcggcgacggaggagacctcggccgcgcccggtccgctcttcaggccggcgacgatcttctgcacctcggccttggggccggggtcggtgaccttggcgccctcgggggccttgatgacgatgcgggcggtggcgccgtcggccgccatgcccgggaagcgctcgtccagcaggtcgaaggccttctgggcctccgaaccgggtatcgagaacgagccggaggtgggcgcggccgccgaggcggcgccgaagccggcggcgaacagcagtgccacccagaggagggcgacgagaccgcggcgccggaaggcgcctctgccgagtcggtagaggaaggtagccacgtcggtggttctcccgttcaggtcgtgggatggatccggatcggatctgggcatgaggagccggcccgacgacgagagcggcgtgtcaggagcagcgaagaagccgtgcggggacggggagatcggggatcagacgccgagggcggggaagaccacggcgtcgatgaagtcaccgaggaaggcccggtccaccggacggtcctcgatcagcgggagggcgatgaacgccccgatgagcatgtgtggtacgaagtcgagcgccggacagtccgggcggatctcgccccggtccaccgcacgccgcagcatcgcctggagaccgttgatctccgggtcgaccagcaggtcgcgcagggccttgtggagctccgggctctcgtggacggcgtgggccagaccccgcatcagcgcggtgtccttggccatctgcgcgtcgtcggagtgctccaccatgagggcgaagtccccgcgcagactgcccgtgtcgatttcccgcagcgagacgggctgggtgcatcgcagggccttggcgaccagctccggcttgctcccccactggcggtagagggtggccttgctggacttcgtacgggcggcgaccgcgtccatggtcagcgcctcgtagccgacgtcacgcaggaggtcgaggaccgcctcgtgcagttcggcctgccgctcgggggtgatccggctacgccgagccgtcatcgcctcggtcatgtccgtgcctcccgtcgcagcgaaactgttccgtacgcttaagacgatacccccaccccaagcgaaacgaaaccgttccgtttcgctcggaggagtggcatggatcacctgtacgagttgccaggggccccctgcgcggaaagcattggggggtgagtcacgacgtcgcgtacctccggttcccgcacctgcacgacgacctcctctgcttcgccaccgaggacgacctctgggtcgccccgctggtccccgacggccagacacccggacgggcctggcgcatcaccgtcgaccggacccgcgtcggccacccgcgtttctcccccgacggcaagcacatcgccttcaccagctggcgcagcctcgaccccgagatccacctcgcccccgtcgacggcgggcccgcccgccagctcagttactggggcgccctcgacacccgcgtctgcggctggaccccgcccgacgaggacggccgcagcgacatcctggccgtgtcctcgcacagccagcccttctcctacttcgcctgggcctacaccctcccgaccgacggcagccccggcggccgcctgccctggggacccgtctccgacatccaggtgcagtgcaccgacgagggtgagcggcactccctgctgctcaccggcaagcccccgcacgagcccgctgcctggaagcgctaccgcggcggcgccaccggccggctgtggctgcacggacagcggctgctggaggacgtcgagggccacctcgactccccgatgttcgtggacggcaggatcgccttcctctccgaccacgagggcatcggcaacctgtactcctgcctccccgacggcggcgatctgcgccgccacaccgaccacgaggagttctacgcccggcacgcctccagcgacggctcccgcgtcgtctaccagtgcgcgggcgacctctggctcgtcgagtccctggaccgggacgccgccccgcgcaagctcgacgtccgcctcgccggcccgcgcgcgggacggcgtacgtaccaggtgccggccgccagccacgtcgactcgctctccgtggacgccaccgggcgcgccagcgcggtcgtggtgcgcggcagcctctactggctgacccaccgcgacggcccggcccgcaccatcgccgacaccccgggcgtgcgggtacggctgccggagatgctcggcagcggcgggcaggtcgcctacgtcaccgacgccgagggcgaggacgcgatcgagatcgcctacctgccccgcgcctccggcgaacgggatccgcgccggctcgcctcgggcgagctggggcgggtcaccgagctgctctcggacccggacggcgagcggctcgccatcgcctccaacgacggccggctgctgctgctcgacgccaccgaggagtccaacggcgaggtcaccgagctgatccggtccatcaacggccccgtcaccgacctcgccttctcccccgacggagcctggctgacctggtcgcatccgggcatcgggcgttcgctgcggcagatcaagatggcccggatctccggccccggcgcccgcgtcgtcgtggacgtcaccaacggccgtttcgaggacgagaacccggtcttcacgcgggacgggcgctacctggccttcctgtcctggcgcggcttcgacccggtctacgacgtgcacaccggcgacctgtccttccccctgggctgccgcccctacctggtgccgctgaactcggcgaccccctcccccttcgcgctctccgccgagggccggcccgcggccggcggactcgacgtggcggaggccgactcgggcgacggcgacggcgccgtgaccgtggaggtggaaggactggagagccgcgtcaccccgttcccggtgaccgcctccaagtactcggcgctgtacccggtgagcggcggcgggctggtgtggctgcgctggccgatctcgggcgcgctcggcgagaccttcgccaacccggccgacatcagcggcaagcccacgctggagcacttcgacctcaccaaggcccgcaagaccgaactggcctcgggcctggactggttcgcggtcagcggcgacggcacccggctcgtgatcaacgacgacggcgacctgcgcgcggtcccggcgaccgaatcgggcgacagcgactcgaccgtctacctggacctgcggcgcatcctgcacgaggtggacccggccgccgagtggcgccaggcctacgaggaggccgggcggatcatccgcgcgtacttctgggagccgaagatgtgcggcatcgactgggacggggtgctggagcagtaccgctccctggtcgaacgggtcgcctcgcccgacgagttcgccgatctgatgcgcgaggtcctcggcgagctcgggacctcgcacgcctacgtctcccccgcgcgccgcaacgaaggccccccgcactaccagcgggcgatcggcctgctcggcgccaacctcttcccccgggacggggaatgggtggtgagccggatcctgcccggcgagtcctcggactccaaggcccgttccccgctggccggcaccggcatccgggagggcgcggtgctcacccacgtggacggccgtccggtggacccggtcaccgggccctatccgctgctggcggcggcgggcgggaccacggtggagctgaccttccagcccgcggcgggcgagggccgggcccgccgggtcgccatcgtgccgctgatcgacgaacggccgctgcgctaccaggactgggtgtccaagcggcgcgaggcggtccgggagatcagcggcggccggtgcggctacctccacatccccgacatgggcggctcgggctgggcccagttcaaccgcgacctgcggatggagatgtcccggcccgcgctgatcgtggacgtacgcggcaacgcgggcgggcacatcagcgagctggtggtggagaagctgacccgctccatcctcggctgggacctgacgcgcaacgcccagccggtgtcctacgcctccaacgcgccccgcggtccgatcgtggcgctcgccgacgaggcgacctcctcggacggggacatgatcaccgcggccttcaaactgctgggcctgggaccggtggtgggcctgcgcacctggggcggggtggtcggcatgaccggccgccacaccctcggggacggcacggtgatcacggtgccgatgaacgccgcctggttcccggagtacggctggtcggtggagaaccacggcgtggaaccggacctggagatccagcgcaccccgctcgactgggcggaggggcggcacgcccagctcgacgacgccgtgcacctggcgctggaactgctgcaacaggacccggccgcggtgccgcccggctacacggacgtgccggaccggcgccgtccgaagctgccgccgaggcagtgagcgggaaggcatgcgggaggggcgcgatccccggtggaacggggatcgcgcccctcggcgctgcgtgcgggcccgttgcggtcgggccagctgcctaggtccggtcgtcgagctcgtcccggatgtcgtcgaaggaccgctgcggcgcgtccttcggctgcggggtccgctgggacttctggtcctgcgggcccttgccgggctgcttctgccccttctgggccttgtccttgagctcctgcgccttgtcctggaactggtccttgatacccatgctgttcactccatgaggggtgttggtggttgggcctcgaccagacttgcatgagcggacaaagctcgcatttcgatcagtgactctgcgtgcgctccctctcgtccgccgccccgccggccccgacgagccccttggacacaccgctcagacgcggcccgaagcgcttcatgtcgcgctgtccgaccgtcgcgatcatccccggcaggtagccgcgcaccccctgcatgccgcgcagccaccactgcgcgtacacgtgcggcgagcgccgctcgatgcccgcgacgatccggtcgacggccggcccgagcgggtacgtgcggttcgccggccacggcagccgctggcgcaactcccgcatgacctcgtcctggtcggcgccgcgcaccatgtccgtgtcggtccaggagaggtagccgaccccgaccccgacccccttgtacccgacctcggcgcgcaggcagtgcgcgaaggcctcgaccccggacttggaggcgcagtaggcggtcatcatcggcgcgggggtgatcgcggcgagcgaggcgatctgcaggaagtagccgcggctctccgtcagtacgggcaggaaggcgcgggcggtgacggccccgccgatcaggttcacctcgatcacccggcgccaggcgtccgggtcggagtcggcgaacggcccgccggcggccacgcccgcgttggcgacgacgatgtccaccttgccgaagcgctgcttgacctcctcggcgacccgggccatggcctcgtggtcggtgacgtcggcgtaccagtggtcgctgtcggtgtgcagccgctgggagacctccttgagggcctccggctccagtccgacgagggcgatcttcgcgccccgggccgacagcttgcgcgcgagcagctcgccgaccccccgggcggcgccggtgacgacggcgacctggccttccagactcctgcgagcgctcacggcgtcttctccttctcgtcggcatcgaggtcggtggtgcggaggtacagctcggccagctcgcgcaggaccccggtgacggcctcgggggcctcgaccggggtcatgtgccccatgccggtgagctcggtcaggcccacgcagttcggcagcgccgcggcgagcccgcgggcgtgcacgatcggggtgagccggtccgcggtgccgccgatgacggcggtgggcaccgcgaggcgcgccacgtcggcgtcgaggtccaggccggccagcacctgggaccacgcgtggcgcaccccggcggggcaggcgtggacgatacgggcgcacgcctcgaccttgtcgggggcggaaccggggcccatggtggcgtacttcaggaccttccgggcgaccggcgtgaccggtcccaggggggcgcgggagccgaggaaagcgccggtgacacgggtgcggacgcgcccggcgcgcaccggcaggaccagcgcctcggcggccagccgggagctgccggtgctgcacagcagcgcggccgcgacccgctcgccgaactccggccggcccgcggccgccatgatcgtcataccgcccatggaatgcccggcgacgaccgcccgctccccgggggccagtacggcctccagtacggccacgaggtcgtcggcgagggcggtggtgctgtgcgcccgcgcggcggggctgcgcccgtgcccgcgctggtcgtaggcgacgacccggtgggtggcggccagggcccgtatctgcgcggcccagaacgcggtggaacaggtccacccgtgggccagcaccacggtcggcgcgtcctggtccccgtggacctcgacgtgcaggcgggccccgtcggcggagacggcgacgaactcccgccgcgcggcgggcggagcgtagggcccggagaggacgtgcgtcagccggctcacgcgacgtcctcggccgttccggcgactccggccccgccggcgtgtgaggcgcgcgggtccgggggcagagccccgggcagcggcgccgcaccggcccccgcggcagccgcaacggcaacggccgggacccgctcgcgctcccccacccgcaggacctcgtactccgccaggtcgacgctccgcgtctcccggcggaactcgcccgtcgtccccggccagaccgtcgtgttgcggccctgcgcgtccaggtaccagctggtacagccgccgctgttccacaccgtccgctccatacgggcctgcacctgccggttccaccggttcacggcggagggccgggcgccgagcgcgaccctcccgcccaggctgcttccctcgaggagggcgagctgccgcaggtagtcggccatgtagttgagctgcgactcgatcatcaggatcatcgagctgttcccgagcccggtgttgggcccgatgatcgtcatccagttggggaagcccgctgcggtggccccgcgcagcgcctgcatcccgtccttccacgcgtccgcgagggtctggccctccgcgcccaccacccgctccgcgatcggcatgtccgtgacgtggaacccggtgccgaagatgatcgcgtcgacctcggtctcggtcccgtcggcggcgaccagtaccgagccgcggatctccttgagcccggaggcgaccaggtccacatcgggccgggccagggccgggtagtactcgctggacagcaggatccgcttgcagccgatccggtaggagggcgtcagcttcgcgcgcagcgccgggtccttgatcgagcgcgccatgttggccttggccagggactcgatgaggccgagccggttcgggtgcttggtgaaggcgctcacctggagctcccggagcccccacagcatcccgcgccgcgccgcccgggtgaagggcagctgacggtggagccagcgttccacggcggtgacggcccggtcggtgcggggcatcacccacggcggggtccgctggaagagggtgaggcgctccacctcgggggcgatggcgggcacgatctggatggcggaggctccggtgccgatcatggccacgcgcttgccgcgcaggtcgtagtcgtggtcccagcgggcggagtggaagaccttgccggggaactcggcgagcccggggacctccggcgtcttcgggtcggacagcgggccggtcgcggagacgaccacgtcggcggtcagctcaccggccgcggtctcgatctcccagcgcagctcgtccgcgtcccagcggatcatccgcacctcggtgtcgagccggatgtgcgggcgcagtccgaaggtgtcggccacgtgctccagataggcacggatggccggctgcccggagaaggtgcgcggccagtcgggattgggggcgaacgagaacgaatagaggtgggaggggacgtcgcacgcacagccggggtagctgttgtcgcgccaggtgccgccgaccgagtcggcccgttccagtacgacgaagtccgtgatcccttcgcgccgcagccgtacggcggcgccgagcccgccgaagccggagccgatcaccgccacccgtacgtgctcgcgtacgcccgtgccgcccgtgccgcccgtcgtgccgctcgtgccacccatgcccgccgccttccgctcatccgcagtcccagccacgcaccgcaacgccgcaccacaccatcgaaacactgccagcaatcactggcgcaatcgggagcgtagagcagctccgtactcatgggtaggggtcgggcccggaaagttactgccggtacgccataaggtgcgtctgtggcgaaggaagagacgcaagcgaagacggtgcgcgagtaccgcacggaggaactggccgaagcggccggcatcccggtccgcaccctgcgcttctaccgcgagcgcaaactgctcccaccgccccgccgcgagggacggatcgcctggtacgacgaccaccacctggcccggctgcgcaccatcgccgccctgctggaacgcggccacaccctcggcggcatcgccgaactgaccgccgccttcgagaacggccgcgacgtcggccagctgggcgagctgctcggcatcggcgggtccgaggagaccccggtccgcctcaccccggaggcgctggccgactacttcgagggcgaggtcaccccggagaacctggcggcctccctcgacctcggctacgtcgccgtcgacggcgacacgctcgtgcacgtcagccgccgcctgctggacgtctcctcggccctggtccacgagggcgtcccgctggcggccgtcctggagaccggccgccgcgtccgcgagcacgcggacgcgatggccctgctcttcaccgagctcatatcggcccacatctcaccggacgcgctcgcccggctgcgcccgctggcgaagagcgtggtcgaggccgagctgacgatggcgatggaccgcctgctggcctcgggaggcccggagggccccggtcaggcgcccagctcgtagacgacggtcacgggcgcgtggtcggaccagcgctcggggtgcgtctcggcccgctccacgaaggccttcacggccttcgccgccagcccgggggtggccacctggaggtcgatccgccagccggcgtcgttgtcgaaggcccgcccgcggtaggaccaccaggagtacggcccctcggtgtccgggtgcagttcccgcaccacgtcgacgtagcccgcctccgcgtacaccttgccgagccactcccgctcctcggggaggaagcccgcgttcttgcggttcgtcttccagttcttgaggtcggcctcctggtggcagatgttccagtcaccgcacaccacgacctcgcggccgtcggcggcggcccgcaccttcagcgccgccaggtaggtcaggaactcccccatgaaccggtacttctcgtcctgcttctccgtcccggcctcgcccgagggcaggtagaggctggccacggtcacaccgggaagatcgatctccaggtagcggccgctgtcgtcgaactccgcactgccgaatcccacctgcacgcgctcgggcgcccgccgcgtgtagagcgcgaccccggcgcggcccttggcggcggccggagcgaagacggtgtgccagcccgccggggtccggacatcctccggaatctgcccctcctcggcccgtacctcctgcaggcagaccacatcggcgtcggatccgtcgagccacgccccgaagcccttcttggcggcggcgcggatcccattcacattcacggaggtcactgtgagcatcccagcaccatagcgggagggttccgtacgatattcgaatgtctcaccggatagacctccgcaccgtgccgtacgaccacccggacgcggtcaaactcaacgaccaggtccagctggagtaccaggagcggtacgacggtgagggcgacgccactttcctcgacccggcgatgttcgtcccgccccggggcctgtacctgctggcctacgacgccacgggcgtcccggtcgcgagcggcggctggcgcacccaggacgagaacgacgagggctacgcggacggcgacgcggagctcaagcgcatgtacgtcgtcccgcaggcccgcggcctcggcctcgcccgccgcatcctgaaggccctggaggcggacgcccgcgcggccggccgccaccgcatggtcctcgaaacgggcgaccagcagccggaggcgatcgccctgtacctctcctcgggctacacgctgtccgcgaagttcggccactaccgccactacgagtccagccgctgcatgagcaagcccctctgacccgccgctccacccagccccgccggccttcgaggcgcgggggtccgggtgcggcgcccccggcaacggcgccgcccccgccccgcccctaccgggggagccagccggcccggtccgccccccaccggctcggcccgaccgcccactccccgaagggactggcggcgtgccgcagcaccccgtaccccgacggcgtctcccgcagccacggctgcgccgcataccccgcaccgcggggaaccccatcccccgccaccaacccccgcaccagccacgaccccgtccccgccagcgagaaccgcagcccccgcccaccgccggaggccagcgcccgcagcacacccgccgcgaccaggtaccccgtcccgtggtccagcgcctgcgccggcagcacccccggcgtcccgtccggtcccgcgcacgcggcggcgatcccgtaccccgcctgcaccagcgagtcgaacccccgccgccgcgcccacggcgcccgcgcccgccacccccaggcgcacagctcggccaccaccagccccggccaccgctccagcaggtcccgcgccccgagcccgtaccgttccagcgcccccggccggtagcccgtcaccaccacgtcggcctcggcgagcagtccctcgaagacgccccggtccgccgcctccgccaggtccagcagcgccgaccgcttcccgaagccggtgtccgcgtacgcgtcgtccgcctccggcagccccggcgggtcgatccgcagcacgtcggcccccagcagcccgagcgtgcgcgtcgcgacgggcccggcgatgacccgggtcaggtccaggacccgcacccccgcagcgggccggccggccggggccgggccgagcggccgtccccgcgcccccgtctgccgtacgggctcgatcagcggctgcggatccccgtacgcgcgtgccacggcgacggcgagtccgccctccccgtacgcgagttcctgcacctcgacggccgtcctccccgcgaccgcggcgcggaccgcctccggtgtcgccgacggcagtcgcaacgcccttaccagggcggcttcgtggtgcggatagttggcgtgcgtgcgcacccagccgtccgccgtccgccagaagccggacaacggggcgaaggtcaccggagcccggccctcgacccgcaggtgccgctcgctgacgaacgccgtggccaccgcgccctcgtccaccaccggcggagccacgtcccgcgccccgcccccggcccgcaccgcggccagctccgccgccgccagcccgcacaccccgacggtcgcgcgcgccaactcggccaccggcagcggcccttccgccagatcgccgcccccgcggtagcgcacccgcccgacgagcccgggcgccccgccgagggcctcccaggcctgggccgtcccgctgtcccgttcctcaccgatcgtcatgaacccatgctgcccggccttccgcccggatctccgccgggcccggccggctgtcggtgggcacgtctacggttctgccgtgccgaactcctacacgaccttgtggaccaacgatctgtgccggtggctggcacggggcggccataccggccagcgcctcacgatgctgttcggcggcccgcaccagtcgctgccgagcttcgtgcgggcaggtgtccgccccggcgacacggtcgtcccgcccgagctgctggctcgtctgacgtacacctcccgccgaggtgaacgcaccctgaggcacgtcgaggacgggcggctggtgcgctcccacggcgtccaggggatctaccggctcgccgccggttcggccgccgagctccgtcagctcgtcctggaccacagcgggtgacgtcctggcgtcacccgctccgcaggcgggaccggccaccggccgagagtgcggccctggaggtcgactcccgtcaaccgaagccatttgagccatagttggcctgaaactgaaggaaccttttcttccgtcaccccactgctcctagcgtgctgcgctgcgggggcgtcgcaggccagagggttacggactgtgctctcccctgcgcttcttcaggctcaccgggaggggatcatgaaacgctcgatacgcgtgttcagcctgttcgcggccgcgatgggcatcctgttcgccatggggcagcccgcttcggccaacagcttcggcccgacctacgcggacaacagtgcgcacagcttcttctacgacgacgacctttcctccgggcagaagtcggggatggaatgggcccgcacccactccctcgaccccaccgacatgtccacgagcgtcgaccgcagctacaacaaccaggtcgacgtctgggcatacgcgacctggaacccgagtggcgaccagaccagctggtacgcctggaccacatgcatcaagttcgtgagcagcggcaagtgcgaccagcacagcatcgtgttcaaccaccgccttccgcacagcaactaccgctcgctctcctgtcacgagatcggccacagcgtcggcctcggacacgcgtcgggccgcaacagcagctacgcgtccgcggaccggtcgtgcatgcgcgccaaccccgaccacacctattacgcggttcacgacaagagccacatcaacggacgttactgacccggagaagaggagaatcgtgatgcgcagtcgaatcgccagggtcgccggggtcgcgaccgcggtgttgctgggtgccgtggggtgctcgtcgggttccgggggaggctcggccgcccaggggcagggcttctggggggcccacggcgccgacggcccgtccgaggccaatgcgccggcgagcatcgaggcgctcgcccagcgtaccgacctcatcgtgctcggcacgatcaccggggtcgaggagggcagggactacacggacccgggcaaggcgccgaaccgcacgtcgaacctggtcctccaggtggaccgggccagcggcggcaagcccgccaccgctctggtcgaagtcacccgcgagccggtcaccgcgctcaaggacatctcggacgccctaccgaagggacagtacgtcttctatctcaagaactggtacgagggccccgacggccctgtgtaccgttgcgcctccccggccaactgcgtggtcggagtcaacgacggcgtgctggagaccccgcgggaccccgatgcggcgcaggagctccagtcctcctcgaaggggctgactcagtcctcgggcaacggcaagcccttgagcgtcgaggacctgttcaccgcgagcacgtcagccaagtgaggtagcggcccgccccggcatccggtccggcccccggtcggcccggatgccgcaaacgccgagatcccgcccggtctttcgaccggacgggatctcgtgacgttcacgagagctactcgcgaactgtcgtctgtggacctgtggggatttgaaccccagaccccctcgatgcgaacgaggtgcgctaccagactgcgccacaggcccttgcgacgtgtgaaacattagcatccccgcgcgggtgctccaaaaccgatatcccggagcgtccgcgcaggtcaccgatcactcgttcgcggcgcgcgggcggtcctcgccctcgtactggtcgaacagcggggtgcggcccctgccctggccgcgcggacgcggggtggtctggggcttcgggtccggcgcgggcggtgcgggctgggcgcgcaggcggggttccgtcggctcggccgtgctggagcgggtcgagctccaggcgtccggggccgccgggcccgtggcgcggggggccaccggggccgtcacgtacgtcggcagcgggaccgggaccggctcccagctgtcaccgcgggcggggccgcgctcgcgctcgcgctgctggtccacccactcggcgtggtcggtctgctcgaccagggcgcgccgtccggcctcctgcggggagaccggtggtgcagggtccggttcgctgccggccgcggcctcgggctcacggcggctcgggcggttctcccggagctgccgtgcggccgcctcggcgcgccgccggtccatggtgaactcgtagcgccgccgctcctggacccgcaggtgcacgatgtacgtgctcagcagcagggcgggcacggcgggagcccacaggtagcgcaggccgcccaccgcggcgacgatcgcgccgagggtgaagaccaggaagaggagtgcggtggtgcgccggcggcgcgcgaggacctggaggcgctgttcgcgccgggcccgctccgcgcgctgctcccgttcgacggtggccggtctcggctccgccctggtcgcgggcacggcaaaggcccgggcgtcggcgtcgacggaatcgaccaattccgtcgcggcgtccgggtccgcgtggggctggggctccgcctgctcgtcacctcgctcacgcagccccttggcgtaacggcgctccattcccgcccggccggaaagcagccgaatggcagtggagaagcgttccgtcggacgggcttcgttcagctcgtcctgcctccggagccacatgggcaccaagtaggcggcccaggccccgacaatgactgcgtagatgaggccgctgctgctcacacctcacaccgtagaggggtacggccgaggggatcggccaattgggccggtgtgtcgcgcgatctcgctgatatcacggactttttttgtgattcttcggatcaggttatgggcgaatcggttacccgaggccattaattcgaacagatattcgcttatcgccgctcggggcggcttccgccattcggcggggactgcgagtggcgcgcccggtgccagcgccgcagcagtccctccgggacctcctccaccgtgacggcgtagacgaggtggtcacgccaggccccgtcgatgtggagatagcgcggccgcagcccctcctcgcgcaggccgagcttctccacgacccgccggctcggaatgttctcggggcggatgcacacctcgatccggtgcaggccgaccttcccgaagcagtggtcgaccgccagcgcgaccgccgtcggcatcacgccgcggcccgccacctcacggtccacccagtagccgatgtggcccgcgcacatcgagccccaggtgattccggcgaccgtcagctggcccaccagccggccctggtactcgatgacgaagggcagcatccggcccgcgttcgcctcggcccgcaggtggcggaccatctggcggtacgtgggccgctggaccaccggcccccagggcgcgggcggcgggatcgtggcctcccacggccggagccagtcgcggttgcgccggttgacctcgcgccaggccttctggtcccgcagctttatcggccggagcgtgacgtcgccgtccgacaggaccaccggccaggtcgggccgttcagctcgtgctcccggagggtgccgccggtctggggtggtcgccgccccgcatctggtcgaccgcgtgcggcaggacgcgggacaggacggcgaggccgtcgcgcaccccgcccgtcgagccggggaggttgacgatgagggtccgccctgccacgcccgccagaccccgggacagggccgcggtcggcaccttcgccaggccctcggcgcggatggcctgcgggatgcccgggatctcgtagtccagcacccgcgcggtggcgtccggggtgcggtcggtcggcgagatgccggtcccgccggtggtcaggatgacctcgtacccggccgccacgccctcgcgcagcgcctgttccacggggtcgccgtccgggacgacccgggggccgtccacggtgaaaccgagctgctccagggcctcggccagcagggggccgcccttgtcggcgtacacgccctgcgaggcccggttcgaggccgtgacgaccagggcccggaccggcggccgcacggcctgcgcggcttcaccggccgcggcgtgccgattcccgctgtgaccgtggctgtggctgtggacctcgccgccgcgcggcgcgttcacgagcgcgcccagtcgccggacttgccgccggtcttctcctccacccggacgtccgtgatgaccgcgcccttgtcgaccgccttcaccatgtcgatcacggtgaggccggcgaccgcgacggcggtcagcgcctccatctcgacgcccgtgcggtcggtcgtcttcacggtggcgaggatctccaccgcgtcgtcggcgacccgcaggtccaccgtgacgcccgagacggccagcgggtggcacagcgggatcaggtcgggcgtcttcttcgcgcccatgatcccggcgatgcgcgcggtggcgagggcgtcgcccttggggacgccctcgccgcgcagcagctcgatcacccgcggggcgacgagtacccgtccgctggcccgtgccgtccgggtggtgacgtccttcccggacacgtcgaccatccgggccgcgccggcctcgtcgatgtgggtgagcctgctctcggtactcattgctgcgccgctccgctctgggctcccggggagcctgtgtggtgcgacacacgctacccgcaccggcccgacttcagccgagcaggaccacttccagctcggtccccggctccaccgaggtgacgtcctccggtacgaccatcagggagtcggcatgcgccagcgcggcgatcaggtgggagcccgatccgccgaccgggctgaccgtgccgctcacggcgtcgtacttcccgcgcaggaactggcggcggccggccggggagccgagggccttgtccgcctccagcacggcccgcacgctcggccgccggacctcggcctccggcagccccatcagggtgcggatggcggggcgtacgaacagctcgaaggagacgtaggaggacaccgggttgccgggcagggccagcaggggggtgtggtcggggccgatcgtgccgaatccctgcggcttgccgggctgcatggcgagcttgcggaagtccatccggccgccgtcgacgtcctcgccctcgtccgactgcccgaccgaggacagcgcttccttgacgacgtcgtacgcgccgacgctgaccccgcccgtggtgaccagcaggtcggcccggatcagctggtcctcgatggtggcgcgcagggtgtcggcgtcgtccgcgacggcgccgacccggtaggcgatggcaccggcgtcccgcgcggccgcggccagcgcgaagctgttggagtcgtagatggtgccggccgtgagcgcctcgccgggctgaaccagctcgctgccggtggacaggaccaccacgcgggggcgcggccgcacccgtacggtgccgcgcccgatggcggccagcagggcgatctgcggcggcccgaggatcgtgccggccgcgagggccaggtcacctgcctgtacgtcgctgccgcgcgagcggacgtgcgcccgtgcctcggcggcgcggtgcacgcgcacctcgccgcccgcctgctcgggggcggcgctggccggggtcatcccggcggccgcgccgccgcccgtgccgccgtcggtccactcgaccggtacgacggcttcggcgccgggcggcagcggggcaccggtcatgatcctggcggcctcgccggggccgaccgtgggcagctcaccgctgccggcggcgacgtccccgacgaccgtcagcaccgcgggaaactcctcgctcgcaccctggacgtcggccgtccggacggcgtagccgtccatggagctgttgtcgaagggcgggagggcgacgggcacggtcacgtcctcgaccaggacacagccctgggcgtccagcagttggagctcgatgggctccaacggccggacggccgagaggacgtccgcgaggtgctcgtccacggaccacagacggtggccggtgtcctgcggtgcggaactgctcaaggtgctacatctcctccgtgacgtaacggtgaagccaggtgcggaactcggggccgaggtcctcgcgctcgcacgcgaggcggacgatggcccgcaggtagtcgccgcggtccccggtgtcgtagcgacggccccggaagaccacgccgtgcaccgggccaccgacgctctcgtcggcggccagcttctgcagggcgtcggtgagctggatctccccaccgcggcccggctcggtctcccgcagtatgtcgaagatcgcggggttgaggacgtagcggccgataaccgcgtaattgctgggggcgtcctggggctccggcttctcgacgaggccggtgatacggaccacgtcctcctcgtccgtggcctcgacggcggcgcagccgtagaggtggacgctggccgggtcgacctccatgagggcgatgacggtgccgccggtgcgggcgtagatgtcggccatctggcgcagcagcgggtcgcgcgggtcgatgaggtcgtcgccgagcaggacggcgaagggctcgcggccgacgtgcggctcggcgcacagcaccgcgtggcccaggccccgggggtcgccctggcggacgtagtgcatggtggccaggtcgctggattcctggaccttcttcagccggtcgtcgtcgcccttggcgatgagagccgactccagctcgtagttccggtcgaagtggtcttccagggcacgcttgttacgcccagtgatcatgaggacatcgtcgagcccggccccgacggcctcctcgaccacgtactggatggccggcttgtccacaaccgggagcatttccttcggggtcgccttggttgccggaaggaaccgagtaccgaggccagcggccggaatcacggccttcttgatcacggggtgcaacatagtcatgccccgaacgatagtggcttctgcagaacgtcagacgagatcgcagcagctagatacgggtatgcccccattcggaaggatatttgatttcctcgtggcagcgaaccctcccaccgcctccgccaaggccggactgcgccgagaactgctcgccgcgcgccgtgccttgtcccccgagaactgccgtgcggcggccgccgcactcgccgtcagagccatggaactacccgaactgaccggcgcccgcacggtggcggcgtacgtctcgatcggcaccgagcccggcacccgggacctcctcgacgccctgcgcgcgaccggcaagcaggtgctgctcccgctgctgctgcccgacaacgacctcgactgggcggcgtacgaaggcccggacggcctcgccgaggccgcccacccgggcaagatgcggctgctggagccgaccggccccgcactcggaccggacgcggtcaccggggccgacgccgtgctgctgcccgggctcgcggtggacggccgcgggatgcgcctcggccgcggcgggggctcgtacgaccgggtgctggagcggctggagcgcgccggggcgcatcccgcgctggtcgtgctcctctacgacgacgaggtggtcgcgcgggtcccggaggaaccgcacgaccaccccgtgcaagcggtggcgaccccgtcgggggtgcgccgcttcagttcatgacggcctgatccgcgccccggcccctacgagccctcgggcttgagggtcagggtgtcgaccgtggccttctcgacggcgtccttgccgaagggccactccagcagctcgcccttggcccacatcgtcgtctggtccgtgtagtgcgcgttgtacgcgtgccccgaggcacccgtcaggttgatccagcgcgacttgtcgaggtcgttgaggttcacgaccatccgcatcgacggcacccacgtgaccccgtacccgctggaggcgttccagccggtcgcgttgaccgtggcctcgccgccgcccacgttccacgggccgcggttgaggagccactgcatgaagccggggccctcggtgccgatcgtctggttcttcagcgtcagctggtgcagccggccccagctccaggtggactggtccttgccgagcttggcggtcagctcccagcgggcgtcgcgcatggcccgggcgaagagctcgtcgcggttggtggccgccggcagggtgacggtcctcggcgtggtccaccacggcgacttctcgtccttgacgaggcggcggaccacctcgaaccagcggtcgccgccgtcgggctgcgcggagtccgaaccgcgggtgccgcactcgcggaccgtcttggcgaggtcgtcggccgggccggtgccgttgccgacgacgctcatgcagctgccctcgatccgcagctccttgggcatcttgtcgccgaaggacagcttgaggatgttgcgccagacggcgttgaagtaggccgcggccgccgagtccggttcctgcgtgtagttccagccgtcgaggagcttctgcgcggcccgcacgcccgggtccgagacctctatcttcgccagcatcggggtgagcagcgcggcgatctcgctgctgttgtccatctgcatggtgcgcatgtcgtcggtcgagatccggccgccgtccttgatcttcgcctcgatgaggtcgttgatccgctggctgcgggcgccgtagccccagtcggtggtcagcaggttcgggtacttgccggcgccggtgccgggctccacgaccgcctggttggcggtgacgatgtagccgcgggacgggttgaggtcccagggcagctcgctctgcgggatgtagccggtgttggagtccttgccgcccttccaggcgtacttggagtcccagcccggggcgggcatccggccgtcgccctggccgcgcaccgggatgcggcccggggcctggtagccgatgttgcccttgctgtcggcgtagatcaggttctgggacgggacctcgaagtcggcggccgccttgcggaagtcgtcgaaggtcttggccttgtcgagcttgaagaccgcgtccatggacctgcccgggtccagcgccgtccagcgcagggcgacggcgtacccgtcaccgcggtcgggggcggagctggcgacgggcgcgcggctgccgaccgtaccgagctcctcgctgcggtcggagacgagcgggccgttgttggtggtgcggacggtgatcttcttgctgtcgccgcccgcgaccttgatgacctcttcgcgggtctcgaaggggagcaccctgttgtcgtagacgtagccctcgggcttgacctgctccaggtagaggtcggtgacgtcggcgccgaggttggtcatgccccaggcgatgtcggtgttgtggccgatgaccacgccgggcatgccggagaaggtgaagccggccacgtcgtactggcactggggcgagaccgcgcggcagtgcaggcccatctggtaccagaccgagggcagctgcggggacaggtgcgggtcgttcgcgagcagcggcttgccggtggtcgtgtacttgccggagacgacccaggagttcgacccgatgccgctgccgttggggccgaggatcgcggggatcttgtccagggtgtcggcgagggaggacagctgcgtgcgcaggccaacggtcgcgccctgggcggcggtgttgccggcgaggccgttggcctgcccgtcgaccggacccgtgacggtcgaggtctgggtaccgacgccgttgccgccgccggatccactgcccgagccggtaccggtgccggagccgctgcccgtgacgccctgcggggtgtactttccgccgtcgagcttgccgccctcgacgatcggcttgttccggtcgaaggggtacggcgggtagagctcgtcgatctgcgcctgggagagcttggtcgccatcagcgcgcggtcgatctcgtcctgcatgttgccgcgcaggtcccacgccatcgccttgagccaggccaccgagtccaccggcgaccacttctcgggctggtagtcatcgctgagcttgagcgcggcgtgctcgacggagaggtccttgccggacttccccttcaggtacgcgttgaccccgtcggcgtaggcctggagattcttcttggtctcggccgacagcttgctgtcgtactcggcctgcgcgacctggcgccagcccagcgtgcgcaggaaggcgtcggtctcgacctggccggagccgaacatctcggagagccggccggacgtcatgtgacgtcgtacgtccatctcccagaaccggtcctgcgcgtgcacgaagccctgcgcgcggaagaggtcttcgtcactgtctgcgtagagctggggaatgccgtgggcgtcgcgcttgacgtcgacggcgccggtcaggcccggcaccttgagtgagccggtcgtctgggggaaggaggcgcgcacgccgtccacgctccagtacgccccgtagccgaggcccgcgacgagagccaggaccaggacgagcacgatcagacgggcgcgtcgtcccttcttcttgacgggaggagcggtttcgttggcgggcatcgctgtccttagaggggcagggtggtcctgggagtgctgggagcaaccataggcgcaggaccgacttcgttgatccgccaggggtggagctgacgaggacaggggcgaacaggcgtttcacaatgtggttatcgcgtaaagggcgcgtcaaagattaggtaaggtaacgaactacttgccgaacttgtcgccgggaggatcgctccgccgggcgcattgaggagggccgcccgctgactgtccacacgctcaatgagcttctgctggtctgctcgctcgtgctgctcgtcgccgtggcggcggtacgcatctcttcacgcagcggcctccccagcctgctcatctacctcggcataggcatcgcgatagggcaggacggcatcggcaacgtcgtattcgacaatgccgagctgacccaggtcatcggttatgccgcgctcgtcgtgatcctcgccgagggtggtctgggcaccaagtggaaagagatcaagccggccctgccggccgcggtcatgctgtcgctggtgggcgtcgcggtcagtgtgggcgtgacggcggcgggagcgcactacctcgtcggactggactggcgccaggccctgctgatcggcgcggtcgtctcctcgaccgacgcggcggccgtcttctcggtgctgcgcaaggtcccgctgcccgcacggatcaccggtgtcctggaggccgagtccggtttcaacgacgcacccgtcgtcatcctggtcgtggccttctcgaccgtcggcccggtggacgagtggtacgtgctgatcggcaagatcgccctggagctggcgatcggcgccgcgatcggcctgactgtgggcttcctgggcgcctacgggctgcggcacgtggcgctgcccgcctccggcctctacccgatcgccgtgatggccatcgccatcgtggcgtacgcggccggcgccatcgcgcacggctccggcttcctcgcggtgtacctggccgcgatggtgctcgggaacgcgaagctcccgcactggcccgccacccgggggttcgccgacgggctcggctggatcgcccagatcggcatgttcgtcctgctgggcctgctggtcaccccgcacgagctggtgcgcgacttctggcccgccgtgatcatcgggctggtgctgacgatggtggcgcggcccctggaggtcttcatcagcctgctgcccttccggatctcctggcaggagcaggtcctgatgtcgtgggcgggcctgcgcggcgccgtgcccatcatcctggcgaccatcccgatggtgtcggggatcgagggcagcgaccgcgtcttcaacatcgtcttcgtgctggtcgtcgtctacacgctggtgcagggtccgaccctgccctggctcgcgcgcaagctgaacctcgggaacggggacgagggcgccttcgacctcgggatcgagtcggcgccgctggagaagctgcgcggacacctgctctccttctccatcccgacggcctcgcggatgcacggcgtggaggtgagcgagctgcggctgccgccgggggcctcggtcacgctggtggtccgggacgcgaagagtttcgtaccggcgccgtcgaccgtgctgcggcgcggggacgagctgctggtggtggccacggatccggtccgggacgcggcggaggcgcggctgcgggcggtggcccggggcggcaagctcgcggggtggctgggcacgggcggacccgccgcacgttagagcgtcgttctaattcggccgaattcgccgagctatgtccgtttttgcctgcttttccgggctctttacatgcgaagcgggcgttaatcccaggtgaagacaccccttgtcgccgaattcacagggcgtggtagtggctttccctgtacgatgaaggcacaccagatcgaaccaactctgcctgacgcagagctggcgcgaccgcaaagcggccgtggcaccaccccgaagtgggcgcccaggtatcactcggttctgcgcaagaggacagctctcggggctcccacatgtacgggtgcggccgctcacaaggcggagcaccgtccgcagacggggacgctctaccaggcagcggaaaggcaaggccgtgacatccgcggtcacgaccgacacgtccgcccgccccggctacgggcagctcctgcgcactcccggcgccctcggcttcgtactccccggcttcgcagcacgactccccttcggcatgctgacgatcagcatcctgctgctggtccagcacaccaccggttcctacggcagcgccggcatcgtcgccgccgtcaccggcatctcgatggcactgtccgccccgctgatgggcatgttcaccgaccgcctcggccagaccgccgtcctgctgcccgtggtcatcgcgcactccgccgccgtctccggcctggccgcgctcgccctgctggacgcgccggtctgggcgctcgcgctggccgccgtacccaccggcgcctcggtgccgcaggtcggaccgatggtccgggcgcgctgggccgccaagctggagggctcgccgctgctgccgacggccgccgccttcgagtccgtcaccgacgagttcaccttcgtcgtcggcccggtcctggcgaccgcgctgtgcaccggcgtccacccggcggccggcctggtcaccgaggccacgctgaccctgctcggcggcctgctcttcgcggcccagcgggccagccagcccaagacgcacgccccgtcgctcaccggtgagaagcgcgccttcgcgctctccttcccgggcctgcgcgtcctggtcttcgccttcctcggaatcggcgccgtcttcggcggcatgcaggtctccctcgccgccttctccaacgagatcggcaaccccggcgccaacggcctgctctacggggtcttcgccgcgggcaacatgatcgccggtatcgccatgggcgccatcgcctggaagatcggcccgcgtcgccggctgatcctgggctacatcggcctcaccgccgccgcgtccgtcctgtgggcggcgaactcgatgatcctgctgggcgcgctcggcctggtcgtgggcctgtgcatcgccccggcgctgatcaccggctacacgatggtcgagcagctggtccccgcgaacgcgcggaccgaggccttcacctggctgaccggctcgatcgccttcggtcaggccatcgccgtcatcctggccggccgcctgacggacgcgcacggatcctcgttcggcttcctggtgcccatgggtgccaccgcgctcgcgctgaccgccctgctgtcgctgcggtcgaggctcgcgccgaaggccccgagccggatcgtgaacgcgtccgcgcaggaggccgcaccctcggccgcggccgagacgcaggcgaaggctccggctcaggcacggtcgacggcgcaggcaacggcgcaggccacggcgaagtcggcggccccggcgggcacccgcaccaccgcctcgccggcctcccgtaaccgggtgaacgagcgtgggatgggtcaccgcgtgccggtgacggtggactgatcggccggaatacgtcaccatggagcgtcgttagcactcattgagtcagagtgccaggaggaaattcgtgccgacctaccagtaccagtgcaccgagtgcggtgagggccttgaggccgtgcagaagttcaccgatgacgcgctgaccgtgtgcccgaactgcgacggacgcctgaagaaggtgttctccgcggtcggcatcgtcttcaagggctccggtttctaccggaacgacagccgtggcgcgtcgtcgagcagcactcctgcctcgaagccgtcgtcgagctcctcgtcgtcctcgacgtcgaccgccgccgccgctcccgccgcctcggcgtcgtcgagctcgtcgagcagcagctccacgtcggccgcctgatcgcttccttccgaggccccgccgcccttaccggcagcggggccttcggcatgctcacggcagggccttagggtggaccgcatggtgaacgcagagatcggtgtcatcggcggctcgggcttctactccttcctggaggacgtctccgagatccaggtggagaccccgtacggatccccgagcgactccctttacgtgggtgagctggccgggcgccaggtggccttcctgccccggcacggacgcagccacaccgtcccgccgcacaagatcaactaccgggccaacctgtgggccctgcggtcggtcggcgtccgccaggtactgggcccgtgcgcggtcggcggcctgcgggccgagtacgggccgggcacgctgctcgttcccgaccagctggtcgaccgtacgaaggcccgcgcccagacgttcttcgacggtgagccgctgccggacggttccgttccgaacgtcgtgcacaccaccttcgccgacccgtactgcccggtgggccggtccgtggcactggcggcggcccgggggcgggagtgggagccggtggacggcggcaccatggtcgtcatcgagggaccgcgcttctcgacgcgcgccgagtcgcagtggcacgcggcggcaggctggtcggtggtcggcatgaccggacacccggaggcggtcctcgcccgcgagctggggctctgctacacctcgatggccctggtcacggacctggacgcgggcgcggagaccggcgagggcgtgtcccacacggaggtcctgaaggtgttcggcgagaatgtcgggcggctgcgcgaggtcctcttcgacgcggtggcggccctgccggccaccgagacgcgggcctgcctgtgcacgcacgcgcacgacggctgggacctgggcatcgagctgccgtagccgcgtctccgtccccggggcgctccggccgcattgtcggtggccgcccctaacctgcgggcatgggaaattggggcgggacggccgtggcgcacgccacggtggcggagctgcgcgagttcgccgcggaggccggatgtggcgtcgacggcgacgaggacctgggcggtggctggtcggcggtgcagtaccccgaccagccggacggcgcggcggcggcgctggcgcgcaggaccggggcgccggtgctcacggtggcctacctggacagcgacgtcggcttcgtcgaggccgccaccttcgccgggggccgctggaaggcactgctgaaccgggtcacggccgagggctacgagatacccgtggatcggttcccggtggaggcggccctggagggcgcgctcgactggtccgccgccgccggcctgaccgccgacccggacgcgatccgggccgctctcaccggatccgcggccttcgcggaggaactcaccgaccagctcctcggcgcgctcgggatcccggcagcggcgcccggcgaggcgaggacctagaaatccgccgtcggctgtcacatcccgcgcggctgtccggtcctccctggtgaaggcggcatcgagaccgccccgaccagggagatgactgtcatgccgcgtatcccgctcaccccgccccgcaccctgctcacgcggatcggggcctggtactcgcgccgtacgtacggcaaggtgctcgaccccggcctggcctacgggcaccactcgcgcgtcctcctctcgtacgtccggctggagcggagcgtggcgaagtggcgggcgctcgatgccgggctgaagcacctcgccgtgatggcggcggcggcccgcatcaactgctcctggtgcatggacttcggctactgggaggggcacgagctgggcctgccgacggagaagatcgagcgggtgccgcggtggaggcccgtgaggtgttcaccgagctggaactgctggtcatggagtacgccgaggccatgacggagaccgagccgacggtcacggacgagctcgcgcgggaactgatcgcgcggctcggcgaggaggcgttcgtggagctcaccgcgatggtcgcgctggagaactggcgctcgcgcgtcaacagcgccttcggcctgaccggtcagggcttcgcggaggcctgccaggtcccgtcccggcggtgaccccgacaatggcggcgtggacaccgaactcccccttgccgaccgcagggtcatcgtcgccctggacttcgacgaccgccgggccgccgaggcgctcgtcgaacgcctcggcgacgcctgcggcttctacaagatcggcctggagctgctgaccgccgcgggccccgggctcgcgcgggacctcgtcgggcgggggcacgaggtcttcctcgacctgaagctcttcgagatcccgaactccgtggccggagcggtccgggccgctggcgcgctgggcgcgtccatggtgaccgtgcacgcgatgggcggtacggggatcatgtccgcggcggtggaggcggcgcgggagttcccgcggctgcgggtgctcgcgctgacggtggtcaccagcatgaccgggagcgacctcgcggacatcgggatcgccgcggacaccgaggagcaggtcctgcggctggcccggctggccgtgggcgcgggatgcgacggggtcatcgcctcgccgcgggaggccggggcgctgcgcggactgctggggccggaccggctgatcgtcacgccgggggtggtgctggagccggagggcccggcgggcgggcacgcccggccggggacgccccgggctgccttcgcggccggggcctcgcacgtggtggtgggccggtcggtggctcgggcggcggatccggtggacgcgctgcggcgggtgcgggcagccggctgacacgtacgggtgacgggattgtccacaggctggggatcgtccacagggcccggcggggattcgcgggagggcggatcgtgggaggtgtccgggcgccgggtccgggcacagcaactcactcggtctggtggtgtccgtcatgtcccgtacctccgcggcctcttcggtctgctccgcttcctccgctcccccggcctcggccgctcccccggcctcggccctctcggtttcccgctcctccgccgctcccgccccgtgcgcggcgtcctccgtgtgtcccccggcccgcccggtcccaccgttcccgccgctccgggtggggcggggcggggaccggctgcgccgggccgtgcggcgcaggcgccgggccgcctcggccgcgctggccgtcgtggcggcggcggtggccgtgggcgggacggaggcccaggcttcgcggggcgcgccgaggcccgaggtgagggcctcccagggagcggctccacccgccgccgcacggccggtgtcggcccccgtgcgcatcgcggacgcggcgacggtgcggctgctgcggcccggggaccgggtggacgtggtcgcggcggagcgcaccgggccgccccgggtggtcgcggcgggggcgctgatcgccgaagtccccgaaccggacaagggtgttgcggacggtggggcgctggtggtgctgtccgtgccgcgggacaccgctcgaacgctcgtgggcgcgggtgccacggcgcggctggcggtgacgttgtgctgattcgcacacacggcgagtcaattcacctccggatgagggccgattggacacgccgcgcctggactgccgtagctttcggaaccgttggctccatgttcggcagatgtgaagagaggctcagtggtgagcgagaagaagaaggagagcgtgctggcaggcttcaaggccttcctgatgcgcggcaacgtggtcgacctggcggtggccgtggtcatcggcgccgcgttcacgaacatcgtgaactcggtggtcaaggggatcatcagcccggtggtgggcgcggtgggcacgcagagcctggacggctacaagtcctgcctcaaggccccctgcggcatcggcgcgaacggccagccgacgggcgtcgagatcctctggggctcggtgctgaacgcgacgctgaccttcgtcatcaccgccgcggtcgtgtacttcctgatggtgctgccgatgtcgaagtacctcgcgcggcaggaggcccgccgcaaggcccgcgagggcgttcaggagctcgtcgagatcaccgagctggaggtcctgaaggagatccgggacactctggtcgcgcagcacggtggcggcacggcccccaccggtccacgcaacggcttctgatccctccggctgcttcggcggccggtcagacgtggtgcgggggcttctcgtcgaggaagcgggccaggtcggcggcgcttccgccggcgggcggccgctcgccccagccgcggtcggtgtcgtccgaggactgctggtccagcgggtcgtcgaagaccagcctgggcttcgggcggggcgtgtcggcctcgggggcggtgcgcgaaggccgcggttcgggggcgggggtgctgctcatgcctccagggtacggccgcccggcacaccggtccggcccccgcccggcccgccggcccggtccggccgggcgccccggccctcctgcgggcggggaaccacctggacaccgccgggcaggtggcacggcacccgaggggcggccacgcccggcacccgccttcggctccggctccggctccggctccggcagcttcagggtcgcggcgcgggcctgggcatccgcccggggcaaacgggtcgtacgggccgcgcgtccgccctgccggacgtccccgcctctggtctcctggccggtatggcctactcccccatgaccgcccgcagccccgacgaactccaccgtgcgtccaccccgcttgagctgttcttcgacctctgcttcgtcgtcgccatcgcccaggccggcgcccggctggtgcactcgctcgcggagggccatcccggtgccggtgtggtcggctacttcttcgtcttcttcggcgtgtggtgggcctggatgaatttcacctggttcgcctcggcctacgacgtggacgacgtcccgtaccggatcgcgacgctcgtgcagatcgccggtgtgctcgtgtacgcggccggcgtgagccgggccttcgacgacaacgactgggcggtcgcggtcaccggctacatcatcatgcgtgtcgccctgaccgcgcagtggctgcgggccgcctccggggagcggggcgaggcccggacggcggcgctgaagtacgcggccggactggtgatctgccagctcggctggatcggcctgctgttcgtgcccgacgacctgaagcgctggctgttcctcgtcctgctcatcaccgagctggcggttccggtggtcgccgagcgcgggcaccagacaccctggcacgcccaccacatcgtggagcggtacggcctgttcaccatcatcgtgctgggcgagacgatcgccgcggccacggtggccgtgaagtccgcgatcgacgagcacgaggcgctggaccggctgctgcccatcgcggcgggcgggctgctgatcgtcttcgccgcgtggtggatctacttcgccgtgccgatgcaccagcacctgacgtccaaccgcgaggccattccctggggttacgggcatctgctgatcttcgcctcgggcgcggcgatcggcgccggcatcgaggtcgcggtcgagcacgcggtcgccaaggcgcacatttcccaggtcgccgcgaacgcggccgtcatggtcccgaccgcgctgttcctgatgatggtgtggctgctgcactcccgccacttcaagcgcggcctcgcccagcagctggtcctgccggtgtccgccctcgtgacgctcgcctgcatctggtcgggtacgcacgccgtcctctgggcgggcctgttcggggtggtgacggttgcggtcggcctgttcctgtccacgcgcgccggtgcggccacgagcgctgccgtctgaatccccgggccgcccgcacccgcacccgtacccgtacccccacctgtacccgcgctcgcgccggtaccccggcgaaccgtcactcccgagcccccgccgccgttctccagcgcagaacgacgcgcaccgactggaggccctgccttgacactcccggcactacgccacggcaccgaccccggcagggagctggccgagccaggtttctggcagcagccccccgcccaccgcctcgcggccttcgcccggctgcgcgcggccgagggaccggtgttcgtccccgaagggtccgggcccggccactgggccctcgtccgccacgcccaggtgcaggaggccagccgcctccccaaggtcttcgccagtgcccccggcgtgaccacccccgagccggcgcgctgggtacgggccctgttcggggactcgatggtcaatctggacggccccgaccacgcccagttgcgcaagatcgtgcagcgcgccttcactccgcgcctgctggcggccgccgaggccgacatccacgcggtggccgcccgcatcgtggacgacgtactggccgaacgacccgacgagttcgtctcggccgtggcctcccggctgcccctggaggtcatctgcaacatgatgggcatcccggagcactaccgggccgagatcgccgaccgcgtcaaccacgcctccgagaacatcggtgtggagcgcggcctggcctcccggctgcggatgccggggcgcgggctgcgcgcgctcgcccgtatgcagcggatggtggcgggcatcgggcgggagcggcgcaagcaccccaccgacgacctgatctcggcgctggtctgtgcgaacgtcgacggccaggccctcggggcccgtcagctcggcgccttcttctccctgttgatggtcgccggggtggagaccacccggaacgcgatcacccacgggctgtccctgctgaccgaccacccggaccagcgggacctgctgctgtcggacttcgagaagtacgcggacggggcggtcgacgagatgatccggcactcgacgccgatcatccagttccgccggaccgtggccgccgggcacaccatggacgggcacgtgttccggccgggcgacaaggtggtcctctactacgcctccgccaaccgcgacgaggcggtcttccccgacccggacgccttcgtcatcacccgctcgcccaatccgcacctggggttcggcggcggtggcccgcacttctgcctgggcgcgcacctggcccgggtggagatgaaggcgctcttccgtgagctgctgacccggccggtcgggctgcgggcggtgggcctgccggacctggcggggtcgaacttcgacaaccgggtccgttcgctcaagttcgccttcgaagggccctgacgagggcgccggcgacgaaggccgccccggccccggcccgggaaaagcggaaccggccaccgggcaggctgggggcccggcggccggagcgggtggtggcggcacccggccggtggctaccgctgcacgcgccgcacggcgaggacgcagtgggcgctgctggtgagcacggactcgtcgcccgcgaaggcctgcagggtctccggcgcgacgggctggcccggcaccgcctccggccaggcgcgggtggcgaagaggaagtacgcctgcccgctctcgtccgccgcggcgacccactcgtcgggggcggtgcagcgcgcgttcatcccgggcagggtgagcgcgatctggttgccctccagcaggatctgcaccgggaaggtggccgccttgagggtgccgtccatgaccacgtcgccgatgggcaggccgatctcctccagcaggccgcgggcggccgcctcgcccgcctcccggcccttcggtccgtcaccgagggtgtaggcgaggaggtacgggatgtcgtgcgcctcttcggggtctccgatccaggcgagcaccgaaagggtgccgagctgggaccggtcgatttcggcttgagtagaagtcatgcgcgcaccctagtggtctctccgccgcgcctttcacggcccttcacccgggcgggctagacggcccagaatccctctccggaattcgcctgcgtgttcgcgtcctggtactggagccgcacaatgcgcgcactttccggaatttcgaacaccacccatccctcggcccgctcaccgacctccagggaatcgaagacgatcggtttgccggtcgtcagctcgccggtcttcaccaccgggtgacgctgccccgcgctgtcgtgcgcccacatgcgcccgagcgccccgtacgaggctccgcccacgttgacgaaggacatcgaggcggccacccagcgcttcccggcgggcggggcgaagttcttgtccacgctgatcgccgggtccacgaacgccgcgagctcggcctggaggtgccggccgacctgcctgccgtgcacctgcacggcgccccccacgtggacgccccgcgcgccggggccgccgggggcctgcgccgccccgggcgccccgtcgtccaccgggaccgccggcgcggcggcgggggcgaccgcgtccggctcgggggcgctctggcacgcggtggccccgaacagcaggagcgggagcaggacgaggacgggcagggggagggcggactggcgcatgcaggatcccttcggggacgtatttcggccagtttcacgcgcccgggcaggtaattgcgcacaacgacacgagcgcgcggagcaagtgcgtacgcccacctgccagcacaatgcgttccggtggattcccgccgtccgcaccatctggaggaagaatgcccatccccgcccgccgaatggccctcgcagccttctccgcactggccgccaccacgcttttcaccgctccggccggcgccaccgttttcaatcaaggtatttccgtacatcatgacgcctacgtcgccaaggacggtgccgtcaccctttccgggacgtaccactgcgagcaggcgtcacccatgggggcgatgcagatcaaggcgaccgtggtgcaggaggacggccggcagctgagcatcggcgccgagcagatcgtctgcgacggccgggagcgccgctgggtggccaacgcgccgggggccttcgtgaacgtgcacccgggccgcgcggtggtcaccgcggagctccaggaggtccggctctcgggcctgatgccgaagtcggtcgacacgctcgcccgggacacgcaggacgtcgaggtccacgagcactgagcggtgcggggcccgcggccggtagccgccgctaccggcagtcgggggcgacgtccgtcatcgacatgaaggccaccgaccggcactcggggtccgcgtgcgcccgccccgtcacccggtccacgacggtcggcaccccggcgaccagcaggagcacggccagcgcgcccgtcacggcggccttgctcagcccgcgcacaacacgatccgttccatggctcgcatcatcaccccgcccccggcaccccacaacccggggtgatcgccgcgtcaccccgtgctccggggggcgcctccggcgtcgaactcgcaccacaccgccttgccgtcgccccgggactccacgccccagtgcgtggccagcgcgtccaccagcagcagcccgcgccccgtggtggccgcctcgcccggggtgcgccggcgcggccacacgctggagcggtccttgacccacagccggatccgccggaccggctccggcagcacctccatcgtcagcaccgctccgccgtcggtgtgcagcagggcgttgaccagcagttccccggccgcgacctccacgtcgtcggcgagctccggcatgccccagtcccgcagggcctggcgcagggcgtagcgggcctccgagaggccttccgggtcggcctggtggacgtactggtggatgcgcggcgcccggtgggtgcccgggtcgggggccctgcgcagcaccagcagggccacgtcgtccccggagccccagcgctcccagagccggtcggagaggtggtcggcgagcgcggcggccccctgggggccgctgcgcaccgcctgggcgagggcgtccatcccggcggtgatggtggtgcccggctcctccaccaggccgtcggtgcacagcaccagggtctccccgggcaccaggtcgagccgggtctcggggaactcctcgtacccgaaggacgaggccagcccgagcggcaggccgccgcgcacgttgggccagcccgtacgcccgtccgtgtgccggatcagcggtccgaggtgacccgcgcgcacggcccgtacgccgccggtctccaggtccacctgcgcgtacatgcaggtggcgaagcgctcggtgtccagctcggcgaggaagcgcgaggcccgggccagcacggtggacggcggatggccctcgcccgcgtacgcccgcagcgcgatccgcagctggcccatgatcgccgccgcgtgcgtgtcgtggccctggacgtcgcccaccacgaccccgacgcggtcgcggggcagcgagatcacgtcgtaccagtccccgccgacctcccgtccgctccaggcggcgtggtagcggaccgcgatctccccaccggtgatctccgggatccggcgcggcagcatggccgcctgcaggccggtggcgaactcccgctcctggtcgaacaggagcgcccgctggagggactgggcgacgatgcccgccaggcccaggcagaggttgcgctcctccgggctgaactcggtgcgccgccggtagaagaggaccagcccgccgatggccttggcctgcgcgatcagcggcaggtaggcggcggcgtcgtactggatccggttcaggtagtccgcgaggagcgggaactcgccgccgagctcggtgagcgaggtgacgaaacgtgcctgccgggtgagcaccgcgcgcgacagcggcagcgagccgtccaggcgggtgaaccggcgctcgctgaggatctccagagactccccgctcaacgcgatgatcttgatggtgccgccctcgaccagtcccagggccagtccgtccgcaccgagccgttccaaggcgcccgccccggtcagcgcggccgtgacgtcgtcgaccgtcaccgcccgcgacagggcctccgtggtccgctgcacgatcgtcgtctgctgggcgcgcgccgcctccagcttgcgcagcagcgtggcgtgggcgagctcggcggtcgcgtcccggacgatccccacgatccgctccggctgccccgcgccgtcccgcagcacccggccggaggtgtgcgtccactgctcgcggccgtcgcgccggtgcaccatgaagtaggcgccgtacgtgtccccgccgccctccaggacaccttcgatgatctgggtcagccggacgccgtcctcgcgcgggatgcgccgtccgaccccgggcacggtgccgtcgaactccgccggcccgaggtcgaagacctccatcgcggcctcgtccagcaccacggtcccggagcccaggtcccattcgagactgcccatgccgttgagggcgaaccgctccccgggcatggtcacgggcgaccgccggaccggctcgggtccgtcccgttccgccgctgccacgttccacaccacctaacggccgggccagcagggctgggagatcagccgctcccactcctcgtcaggatgccccggaagggtgcgcccggcctcccgccagcgcttgaccacggagaggtagatcgtgggctggtcggcgtgggaggccgtcgcgtacggacccgcgtacgggcccgcgtacggaccgggatacgcggtgcggtcgtacccggcggccctggcccgaccggcgggctgttccccgcggctggccggaatgcgtacccagccgcggccctgcgctcgatccgagctcatcacggacccctctctccgcggctctcaccgcagatacgtcttcggatgccctgggggtacccccggaaggtgcccgggggcagcggcccggcccacccgggcggcaccgggggaacccggccgcggaccccgggccccgaggcgcttgcggactcctctcaccagtctccccgccgtgaagcccgcgccgtgcacgaatcgcatggaagggccgaatgagggagccgtcagcagccccgcgaagaacagtccgggccacgaggactcgaacccggggctcagttccggcgcgccgctctcccccacggtctccagcgcggcccgcagccccgcgtcgagcagctccagccgggccagctccgggacgaagccggtggccgcgatgacgtgcgcgacgtccaggaccacggattcccccgcccgggtggacagccccagccgggtccggtcccccaccgccaccgcccggtgcagccggtgcccgagcaggacggggacgcgccgctcgaagcggtcccgcagccaccaggcgccggccgggcccagcgccgtcgccgcgatccgctcccgggtgggcgcgggcagccggcgcaccgcccagggcagctccgaccacacccagctgcgccagccggtgccgagaccgctgtggggctcgcgcagggcccgcagcggggtccgttccaggggctgcgggacggtgttccagttcagccgggaccgccgggcgaccaggcagggccgggcaccctgctcggccagcagggcggcggtctccagggccgcctgcccggccccgagcacggcgacctcacggccggcgaaccggctcaggtcccggtggccgctgctgtgcgagtagtgcgcgggcgggaggtcccgcagcgccccggggtggcggacgaagggcatcaccccgaccgcgagggccaccgtccgggcgagcaggggcggtccctcggcggtgcggacgcggaagccgtcgccctgcggggtcacctccagcacggtcacctcctccacctcgggcgcggcctgccgggcgaaccacatcccgtacccgctgaacgtgccgatcggcagcggagtgccgtgttccgcggtcatgccgagggtggcgcagtaatcggccagggtgtgccgtccgtccggcgcggacaggttggacgaccagggctccgacttcaggtacatgccgtcgggcatgtggtcgcgccacgaggccatgggccgccccagcagccgtacgccgagccccgcggccgccgcgtgggcggcgatcgacagcccgtacgggcccgcgccgatcaccacgagatcgtcgatccgcgtcaactccgctcctccagctcgatggtcaccggcccggcgcggtccgcggccggggtccgggtcaacgggtcaccagctcgtccggctccgccgaggcctccggcggaacgggcctggaggccggcgcggtcgatccggtggaaccgtcggacgactggttccggccgcgctgccgcggcgcgcggacgaccgcgagcgccgtgcgccggccctgctccggaaccccgcgcagcgcccgcacccccttgcccgcgccccggcccagcagggcgccgagcatcgccaggaacggcagcaggtcgtcggcggcgaaccaggccgtctcgacgcgcccccgctcgccggaccgcttcggggcccgctcccgggccggctcccgctccgcgcccggagccggggccgcggacgcggacgccccggtcggcccggccggacccgcggggaccgctgccgggcggcgcggcagcgacccgccccggaccgtcgccagcaccgcgtagttctccgcgacgaacacccggcccggtccgcccgaaggccgcgggacctgctggcccgtcaggtccaggtacatcgcctgtacgacgtccagcccggccgagtccgcgaacagccggaactgcgcgcccggccgggggttgaagtccaccagccggaagcagcccagctcgtcccggcggaagtccaggtccaggatcccctggtagcccaggcgttcggcgagccgcagccccgcctcctccaccgcgggatccggcagccagcgccccacggccgtcagtcccgtccgcaccggccaggacagctccttgcggcccgagcccgcgagcagcggacgcccgccccgcgcgaaggcgccgtggaagaaccagtcggtgtccggcccggccggcaggaaccgctggagcagcagcctgctcccggcctcggcggagcgctcgtagagccggcgcgcctcggcggtggtgtgcacgagcatggtgctgcgcagcccgtcggccccggcgggcagcagccagggccggctccacttggcgatcaccggcaggccgagccgccaggccgcctcggccgcctcggctccgctcgccgggatcacggtctccgggtgcgggacgtcccaccgcgcgcagagccgcgacagctcggccttgtcggccacccgggcgggcaggttgtcgggctgatggggaatccggaagcgttcgcggagcatcggggcgacccgggacacggcgatcgcgctgaggtcgtccatggcgatgagcacggccgggcggccgatccgctccgacaccccggtcagacactccagcagtgcctcgggcgcctcggggtccagcccgccctccggtccgggatgcacggcgcgcagatagcgcgaacgccccatgggacctcccccggcctcgacgacggcatggacctccacgcccttgcggccaagggatctgacggcgccgagggttccgtggtggaacggattgcgatcgagtctgagcacaacggcgggcacatggttgagatacgcgtgcatggcagcggtgtctttcacctagtcggaccaagcgggggtggtgcgcacctgctaatggcctacgcggcagtcaccggacaggccattcgtcagatctgatgcctaacgtctttggtaagcacaccgattcaggaaagctcgggagacgccatgcccagaccacgccgccgactggcgagcacctgcatcggtacggtcacggccggacttctggccaccggggccgccctcgcgacgcccgggaaggaccggcccgagggctccgacatcgccatgggcgcctatctcgactacgggccgcccggcgtggccgggatcccgcacctgtcgagctggctgggcggcaaggacatccgggtcgggcacacctatctgcccggcgaccggtgggccggcatcgagggcagggtctcgttcctggaggactgggccgactggcggctggccggggacgaccggctgttcgtcctcaacgtgcccatgcaggagcggaacgaggaccgggtgcccgactaccaggtggcccggctgatccgggcgggcgcgcagggccggtacgacgagcacttccgcaggctcgcagagcggctggtggagctgggcgtcccggacacggtgatcgtgctcggctgggagatgaacggcgtcacctacacccaccggtgcgcaccggacccggagaactggaaggtgtactggaagcgcatcgtcaacacgatgcgcgccgtacccgggcaggagttcaggttcgacttcgccccgaaccggggtgcggacgcgatcggctggacgaagtgctaccccggtgacgacgtggtcgacgtcatcggaatggactcgtacgaccagggtcccggccagaccttcgacgaccagatcacccagccgtacgggctccagcagcaggtcgacttcgcgaaggcacacggcaagccgatctcctacccggagtgggggctgttccggcgcggggacaatccggagtacgtgcggcgcatgctgaagtggatcgcgcagcacaagccgctctaccacaccatcaccgactactgcccgcacggtgtgtggcagtgcaagcagaacccggagtcctcgaaggccttccgcgacgcgctgacgcccgagcggcccggcccggtggtcccgaccccggtggtgcccacgcccgtggtgccgaccccggtggtcccgacccccgtggtgcccacgccggtcgtgccgaccccgcaggtcccgacgccgcagatcccgaccccgcagatcccgacgccgcagatcccgacgccgacgcccgtggcaccgactcccgtggtcccgacgcccacgccggtggtgccgaccccgcagatcccgctgccggtcaccccgagcccgctcgtccccacgccggtcaccccggtgaccccgagcccggtcgccccgagcccggtcctcccgacacccgaggtcaccgaccccgaccccgacaccgaccccgtaaccaccccgacgcccacgcccacgccgaagcccactccgaagccctcgccggcggtcccgacgccgcaggtcccggcgccctcgccggtcaccccgagcccgctcacgccgaagcccgtccccacgccgccgaagcccctgccccagcccacgccgccgccggtcaacagcaagcactggtgcgtgccgctcaacttcggcgagtggctctccaagctggtcggcaaccagtcgatctgcatcaagctggacttcggcaaggaatccggattctggcccttctagacgggtcatcgcacccgcagttcgttgagtcgcgcccgccagtccctggcggccggcagcgcctcccgcagcgcgtccaccgcccgctcgcgccccgtcacctgcgactcgtgtacgcgcagcaggggcgcgagcgccgccgtggccagcaggaaccgctggttgacgaccgtctcgggccgccagtggttcttgtacggctcgttgccgcgcaggaagctgaccaccggccggccgtcggcgagcgcccgcccggcctcgtagcgcagcagcagcgtcgcgatgtcgaccttgcgcgtccgcagatccgggtcggccccgtacaggtagccgccgctgagtccggcggacagcagagtgacgttggccgccaccaccttgccctccagccggaactccgtcagccggctctccccggcccgcaccatccgccgggtggcccgggtcaggtgctcggcgaagcggggccgcaggtgctcgggggtcaccccgcggccccgccactgcttctcgtgcagccgcagcagggtccttacggcgcgcggcacttcctgctcggtgacctcgtgctcctcgatcccggccgcgtcggtcttgcgcagtttggcccgcacccgctggccgccggaggccggcatccgcttgaccagttcgtcgaacggcagcgtgggcagttccatgcaggtggagtcggcgagcacgctggagaccccgggccactgccggtacagctcctcggcggctgctccgggacgtacctcccgcaggtccacgacggcgccgcgggcggcccggtgcagccctcgggccagcgccgggacgacctggtcggcgtactccgcgtccacgagcacgtcgaagtagtcggtgatggggccgccgagcggcaccagcagcggcatcggccggtgtacgagcatcagcgcggccgcgccgaccagctcctcgccgcggcggacgaggacgatccggagccggccgtccttgccgtacgacagccaccaggagtgcagccaggcgtggctctggaagggggtggcggtggggcagccgcggaagagcctgttccacgactcctccagcgcggcgaactgccgggggtcgcggcacagcgtcaccgacagggccccggcggagcccgaactcatcgaacggactccttctccttggccgaggacggctcgccctgcgcgggcagcgaggcgtactcctcgaccggggtctcgacggcggcctccaccgaggacccggacccggcccgggacccggcggcgacgccggtcgcggcgtcctcggaacgccgcgcgcggcccggccgtgccagcatccacaggccgcccagcagtccgccggcgcacatcccgacggcgccgctgatggcggcggacggggaggcgggcgcggagggggcgaccgcctggttgaagaggagcagctggacaccggtgttcttggcggcctggttgctgctcagggacagggcgtcggcgacggcgttcgcgatgtcggcggcctcggccgggctcttcgaggtacccgtgacggcgatcatcggggactcgggggaggtctcggcccgtacctgggtccgcagcttcgcggcgctgatgccggcccgcggctgggcgtaggcgagggtggaactgctggtcgcgatacgggcgtaggcctgcgcgaagccgagggcggtggccggctccgtggtgtcgtcgggtacggcgacgacatagctggtggcggcgtactcgggggccttgagcaccccgtacgccccgcccgcggccagccccagcagggcgcaggcgggcagcggccaccacaggggcgccgacagcctccggcggcgcggcctccgctcggagcggtgctccgccttccgctcggacctgctctcggacctgctctcggtcttcttctcggcgttcttctcggacgtgtcggccatggacgtgctcgcttcctgggtggagggggagttcgttcgggtcccgtcgggaccccttcgggcagggagggatcagccggtgccggtcggctccgccggtccgggcccggccggctcgcgcggggcaccgacgacggctgcgccgcccgcgcccggtaccgggtcggcgccggggcggccccgggccgccccggtggcccccggcgcggccgcgagggcgaggtcgtacacgtccagcagctgccgcgcgctgcgggcgatgtcgtagcggcggaccaccggcggcgggggcagccggcgcgcgccggcctccatgtggccccggagcgccgcgaccagctcctccgtgccggtgccgatgcggcgggccccgggggcctgcgcggcgggcaggtcgtcgatggccgggcaggtgacgtgcaggacggggagtccggccgccagggcctccacgacggcgagcccgaaggcctcctcgcgcgacggggagacgaagacgtccatggcggccagcagcgccgggatgcccggggtgcggccgtccgcgctgtcgcccagcgggtcccgctcccccagcaggtggatccggctctgcgcaccgagctcggcggccagccggcgcagccccgcccgctccggcccgtccccggccagcagcaggtgcgcgcccggcagcgcggccacggcccgcaccaggacgtcgaaccgcttgccggggaccagccggccgaccccgccgaccacgaaggcccgctcgggcagcccggtgcgggcccgggtggcccgccggacgccctcgtcgaagcggaagcggacggcctcgatcccgttcggtacgacgtgcacccgcgcggccggcaccccccacccctccagccgggcggccacggtgtcggagacggccaccgtggcggcgcccaggcgttcactggccaggtagagcctgcgcaccccgcccgacagcggcctgccctcgatctccccctcgccgagcgagtgttcggtggccacggtggcccgggcgcccgcgagccgggcggcgaggcgcccgtagacgcaggcccggtacaggtgcgtgtgcacgaggtcgtagccgccccggcggatgaacttcaccagccggggcagcgcccccaggtcccggttgccccgcatgcccaggtggacgacgcggaccccgtcggcgcgcagcccctcggcgacgggcccggggttggtcagcgtcagtacgtcgcactgcatcggcatgtggcgcagcagcagccgcagttgctgttcggcgccgccgacgccgagcccggtgatgatgtgcagtgccttgaccggctggagcgccttcaccgctgcaccccgcgccgcagctcgcgcacctggtggcggagctgcttgagccgcagccgggcgccgccgtcggcctggctgacgtgcgtgcgcggcagcgcgtgcgggccggcgagccgtccggggtcgatggcgcaggcatagccgtagccggcgtcgcgggtggcgtcgacgacccgggcgtcgaggtgcccgtacgggtagcagaacccctggggcatggtgcccgtcagctcgcgcagcaggtcgcggctgccccgcagttcctgctggagcacctcgtcggcggtcgcggtgaggtcctggtggagcagtccgtgcgagccgatctcctgtccggcgtcggcggcttcgcggatgccctcggcggtgagcagggacttgcgcgggcccagcgggtcccacacgttgtccacgccgagccgcccggggagcacgaagagcgtggaggtgaagtcgtagcggctcagcagcggcagcgcgtgggtcaggaagtcggtgtagccgtcgtcgaaggtcagcccgaccagtccggccccgcgcccggccgcgcgggcccgcagcagttcaccgacggacaccccgcgcaggccgcgcgagcgcagccacagcagctgggcctccagggcgagcggggtgacggtgatcccgtacgggtcctccgcggggtcggtgaactcggcgaccgagtggtacatgaggacccacggcgaagcggtccggcgggtgggtaccaccacggcggcgggggccgtgtcggtgtcagcggacattgcggaacctctgcgtgagctgggagatctgaccgggcagggcggtgacttcgagggcgcgtatggccgtgccggtggctccgaacatggccgggaccagcaggcagccgagggcggcgctgagcatcgggtcggggatcatcggtccggcgatccagccggcggcgcccgcggcgacggcggcgacggcgagcttcccgatgctgacggcgacccggcggacctggacggcgatgatccgggagccgaggccggtgagcagcagggcggcggtggtggagatgccggcggcgttggcggcggcgatgccgtaggtgccccaccagccgacggcgaacgctccggccacgatgttgacgagcagtccggcacccatcgcgagcgccgggaaccaggtgggccgggcggtcgagaagaagggccgggacagtgcgccgacgaggcagtggccgagcagtccgcatgcgtagacccgcatgacggaggcggtggcgagggtgtcctggtgggtgaaggcaccgcgttcgaagaggacctggatgatctggggcgcgtagccgatgacgagcgcggtgccggccaggacggcgagcgcggccagcgtgaggtcctgctccacccgtcggcgggccttctcgcgctcgcccgcggccatggcctgggcgacgacggggaaggtgacggtgcagatcatcagcgagagcaccatcggcatctgcgcgaccttctgcgcgtagttgaggtgcgagatcgcgccgggcgggagcgaggcggcgaggaacctctcgacgagcacctgcgactgccggaagaccgcgaagaagatcacgggggcgatgaccccgaaggcgatgagggtggggcggtcccggtcgcgctggctgcgcggggcggtcttcttcgcacggggctggccgaagcccacgttccgcacgaaggcgggcagttggacgagcgccatgaacagtccgccgaccgcgacgcccgcggcggcggcccggacgccccagagggcgtgcagggccaccatcgtgccgatgatcccgacgttgtaggagacgtagatcgcggcgggcggcaggaaggaccggtgcgcccgcagcgcggcgctgaagtatccggcgatgccgaaggagagcacggtcagcgcggtgaaccgggtgcactcgacggccagtgcggggtcgggcaggccgggggcgagcacggagacgaccgccggggcggccacgacgagcagggaggcgacggcggccaggaacacggcgaggcgcggcagcgtcgcccccaccagcagccgtacggggtcctgggcgcgggcctcgctgcgcgtgagcccggcccgggcggcggcccgccgggccagggcctggctgaaggcgggcaccatcagcagcgccatggcgtcctcgatcagcagcgtcgaggccatctcgggcacggtccaggcgatgaggaaggcgtcgctgtcgtgcccggcgccgaagaggtgcgcgatggtctggtcgcgcaccagcccgagcagggccccggcggcggtcagtccggcggtgacggcggcggccttggccaggaacctgccgagcggctggctcccgccggactgaccgccgccgggggcgctcccggcggggccggtggcggggccgcccggccggccttcggacccgacgccggagccgttcgcgcggcgggcctggcgcagccggttccgtccgcccggggcggcggcaggaccgcccgaccgggcctcggggtcggcggagccgttcgcggtccgcgccgccacccgtacgctgtgccggcccgaggcgcctcccggatacccggcggagccgaacacggccctgcgcgcctccggttcggcacccgggatcccgctggcgacgaacccgggatccgccgggcccgacgcaccggagccaccgggggccgtggggcctcccggcccgggggcgtgcgggtggccggcgaagccgggggccggggcgcccgggacacgggcgtggcccgccccggccggggggccggaggcgggccgccaaggcgtggtgtccgtcacgggcgagccgcaaccccgggggacccaccccgtgtgcccgcggtggccgccccccgggaaggaagtgcccaccaggccgccaggccgatgatcactccggtcagaaccgtggacggtccgccgatgtcggcgtagaggaagtcggtcagctgccacacgaacagcccgatcgcgatcagcccgcagtcccgcacccccgcgcccctgcccgcgtccgcggcgaaccgccgcagccccgccaccagcagcgcggcccagccgccggcgagtgcgatcagcccgatcaggccctgctcgctcaggatcagcaggtacatgttgtgcggggagagcagcggctggcgcaggtacgcctgcccggcgccggcggtgtcgcttccggaggacaggcccagcgaggcgtgcccgtcccggttggccgggaagcccttgagccccacccccacggccggccgctcgcgccacatcgactcggcggcggcccacatcgtgtagcggtcggtcaccgactggtcgggggcgctggacacctgggtgatggacgtgagccgctcggcgaccatctccgagccgaccccgaacccgcccaccagcaccaccgcggcggcggcgagcgcggcgcccaccttcagggcccgccggatcccggccagcgccatcacgagcaccgccgcgccggcggtggcgatccacgccccccggctgaaggacagcaccagcgggagcaccagcgccagcgcacagccgccgccgatccgccgcaggcgccgcggcagtcccggagcgagcccggcggcggtcgccacgatcagcccgtacgccacgacggtggccatgcccatgacgtcgccggggccgaaggtgccgacggcccggacgtcctcgccctggtacgaggccccggtgtgggtggcgtactgcacgacccccaccgcgccctgcaccagcgccaggaccacgaagcacccggcggccagccggaactccccggcgtcgcgcaccagcagcaccacggccgccgggaccagcacgaagacctgcaggtagcgcacgaagccgggcagggcggcgtacggatcccccgcggtcatcgtggcgaccgcgaggcccacggccggcgccccgagcacgagtacgcccagcggggtcaacgcccgtacccggccgcgcagcgcctgcaccgcgcagacgaggaccagcaccagcgaggcggcgtcggccggaccgaccttcccggaggcggtggcgtcccccgccgggagcggggccagcaggaacagcacggtcgcggcgagcggcagcagcggccagtggcggcgcagcaggcccggcatgtccggccggatccaccggccctggacgacgagactcatcagctgccccccagccggaagcggaagaaggaggccgcggtgcgggcgaggatccacaggtcctgccacagcgaccaggtgtcgatgtagtggttgtcgaaccgggcccggtcctcgatggaggtgtccccgcgcaggccgttgatctgggcgaggccggtgatgccgacgggcatccggtgccgggcctcgtatccggggtgcacggtggagaacttggcgacgaagaagggccgttcggggcgcgggccgaccagggccatgtcaccgcgtacgacgttccacagctgcggcagctcgtccagcgaggacttgcgcaggaaggacccgaccgggctcatcccgcggtcgcccgcgaccgtccagcgcgtggcggcctcgtgcgcgtcggcgcgcagagtacggaacttcagcagggtgaaggggcgcccgtacaggccgacccgctcctgccggaagatcacccccggcccgtcccagacccgtacggccagcgcgcacgcccccatcacgggcgcggcggcgagcagcgcgatcagggcgagcacggtgtcgatgccccgcttggcccagcgctccagcggccgggccgggcgcgggagcagcggctgcacggcgtacccccacagctggtcggtggggtgcggcacccgcatgccggtgaccttggcggtgccggccgggtcggcgagccacatgcggcagccgtggtcgtggaagaggcggaccagggcggcggtgcgctcgtcggcctccggggggcgggtgaacacggcgtgtccgacggagttctggatgaccgcgcgccggatgtcctcgtgggtggcgagcagcggcaggacgccgccgtcgccctcggcgggcgtcgtggtgtcggcgagcccgaccgggcgcagcccgaactcggggcggccgtgcagggccgcggccaccgcgctcgccccggcgccgggtccgacgacgagggcggaggcgggccggcgtaccgccgagcggcgccgggactggttgacgaggccgcggcccgcgcacgccagtacggcctgcaggcagacggcggtgagcagtgcgctccagcccatggcccgggccgggtcggcggcggccgtgacggcggcgaccgagcaccacaggacggcggaccgcccggccagcacgggcagttcgaggagtgcggagggggcgagccgcggccggtagagcccggcctgcgcgtgcagtgcggcgagcaggacgggcgccgcgtacaggacgggcggcgccgccgcgggcagggtcgtcgcggtgagtacggcggccagcgcgtcggcggtgagcagcgggagcacgcggccgcggcggcggacgcgccgggggcgtacggcggagcgggccgggtcggcccggggtccgcgcggggggtggatggcggtcgctgaacggcgggccgccgcggggtgcgcgggcgcgaaggcgcctccgccggtgggccccgtgccgccctgcccggtgtgccgggcgggtgcgctgtccatcgtcatcggctgatgcgctcctggttcaagggccggggcctgcccagcagttcgtggtacaggccggtgaccgcgtccgtggtccgccgcacgtcgaagtcggtccgggcgtgctgccgggcctgctcgccgagttcggcgaggagccgcggctcggcgaggagccggcccagggcccgggccagggccgtcgggtcctccggcggcaccaggcacaggcgtccctggcccggcggcaggctctccctggcaccgctgacgtcggagaccaggaccgggcggccgcaggccatggcttcgagcggggcgagcgccatgccttcccaccgcgacggcagtacaacgagatcggcggcccgaagccacggtcggatgtcggcggcgacacccgcgaagtggacgctggtgccggacggagcggcggcgcggcgcagcgtttcggtgtcggggccgtccccgacgagggcgaggcgggccgcggggacggtggcgagcacctccggccaggcgcgcagcaggatgtcctgccccttctgggggcagatccggccgacgcacacggcgagcggtccgtcggccgggaagccgtcgggcaggggcagttcggcgcgggcccgggcccggtcccggtcggggtccggtccgccggggcggaagtggtccaggtccacgccgttgcggatcaccgaccagcgggcggtgatccccccggactcgcccgcgcggcgttcggcgtcgctgacgcagagcacccggtcggcccagcgggccccgtaccgctcccagcgcagggcgagcgcggcggtggccccgccgaccgcgtcgaaggaccaggcgtggggctggaagacggtgggcaggctgccgcgtgcggcgagccggccggcgaggccggccttggcgctgtgggcgtgcaggaggtcggggcgtacccggcggagcacctgccgggcgccgatgatctcgccgggcagtgcgggcccgggggcccgcccggcgcgccaggtgagcacttcggccccggcggcccgggcggtgtcgcctagcgtgccgccgggcggacacccgacgacggtgcgcagcccttcggcggtctgcgcgcggacgaggtcggtgacgaccctggccacaccgccgtcgacgggctgtacgaggtggaggacggtcgcgggcggtgccgaccgaggttgactgggcacgtggagtggtctcctacgttcagcggcgcgcgtctgtctgaacgaagagcacaccgaggaaatgaccctgactttcacccgtgaacctgaagctcagactgcgggcaccaccggacagggcgggactcaggtcaaacacgtccgcgtcatatccgagattgttcatatgttcgggctgtcgcacgaacgattggtcgccgaattccgtgatcgtggaattcataacatcattaaaaggattttcttcatcgctgatgctcacccggcgaccactgtcggccgtcacggtgagtgagtcccccagggtgccgcggtccccgtcgtagccgaccaccccgacccggcccgcggagccggccggcgcgtcgaggccctcgatctgcaccgtcgcgtcggcggcgcgggcggcgatcgactcgaagccgtcccacagcgagatccggcgcaccggctcctgcgggtgctcgtaggcgacgaccagcgtccagccgccccaggccccgaccgcggagtgacccatcgcaatgttgagctgagccaccgtccacagaccggcgccgcccttgcggaccagcggggtcacatcggcggaggcctggtaggcatcgctgcccgcgtccgtgcggtggccggtcaccgtgtcggcgaggacctccttgtacgccccgccgggctcggcgaccagcacccggccgttgtcctccggcggcttctgctcgccgacccgcaggttcccgccccagtagaggcgggcgtacgagaccttcgcgccctgcgggaccttgagctcggcccgggtggagttgtaggtgtccggatccttgtcgacctcgctgtagaacatctcgaagtcgctgttgaccccggccgcacccttcttcacctcggcgcacggctcggcctgcggggactgttccttgcggcagctgatgccggagttggaggcgcgcaccagcccgccgtgctgcacggcctggtaacgctgggtgaacgggatccggggcagctccttgggagcgggagccgccgccgccgccgtcggggcggtcacggaaagggtgaggcaggacagcagaccgagcgtgccgaggattctgcgggaggaacccatgaccctgtctccattttcgatcaaggggacaaaacaggagtgaactttgtcagaaatcgggctggaaatcacgtcggactcgctcgtacggccttttgggcgatagcacgcaccctcgcaacgggcgggtcgttatggcttgcaccattgttcgaaccgaaaggaaatgcggagatgaagaagaggctggtgcgcggcaccaccctcgccgtcgcgagcgccgccgcactggtgggcggcgcgggcctcgcctccgctcacggcggggacgccgggggaccccacggcgtcaccgcggggtcccccggcgtcctgagcggcaacctgctccaggtgcccgtggacgtcccggtgaacgcctgcggcctctcggtgaacgtgatcgccctgctgaacccctcgttcggcaccacctgcatcagcgcctgaccgtcaaccgtgctgcccgaaacgcccgcatccgagtgaagccacgcaacccgaagcagggctgcggcgttgttccggatgctccgctaccgggcaatcctgcaaaaaagggacgacaatgatcaagaagatgatggcctcggccgcggttgccgcctcggtcgtgggcatcggtgccgccatggccccgcaggcgatggcgatcggcaacgacaacggcgtcaacaccgtccagggcaacggcgccgcgcagatctacggcaaccaggccacctacggcaacatgagcccgcagatggcgctgatccagggctccttcaacaagccctgcatcgcgctccccgcgaaggccaacgtgcagtcggtgcttgccctcatcaacgtcggcgtccaggacatccccgtcctgtccagcccgcagaaccagcagtgcaccgagaactccacccaggccaagggcgacgaggccctctcgcacatcctggacaacatcccggtcctctccggcaacgtctcgaacggcagctgaccgaggcccgcgccagcgaggccgtcgcacccaccgggtcgcggcggcctcgccgcgtatagggccggggcgcccccggcccccggaattgtcgatatgaatccgccgccctaattaattcgccccgcacaccggaccgggcatcggggtgaattaacggcggatcgccgaaaaagcgcggtttccttttcccggaccgctcgttgttaattctgcagtggacacgcctctgcgggaaggaaagagaacaaatgacgtacaagaaggcagtggtgctggccgccggcgctctcatgctcgccggtgccgcctcccccgccatggccgacgcggccgccgacggaaagaccgtgggttcccccggcgtcctgtccggcaacctggcccaggtgccggtccacgtcccggtcaacgtctgcggcaacaccgtgaacatcatcgcgctgctcaacccggcgttcggcaacacctgcgtcaacgcctgacgaagcgcttgtgcccgcgagggcaagcctcctcggtgtggcctcggagtgcacggcggtgcactccgaggccacctccgattccacaccggccgtggcgccggtagacagggaaggacccatgcgacaggtactgagccgacaggtactgggcaaggggatgctcacggcggcagcggcgtcgagtctgctgtcgatcgcgaccggcgcggcctacgcgcaccccggagcgagcgccgaggcctcgcattcgccgggcgtgctggccggcaacagcgtctcggtaccgatcaccttcacacccaacgtgtgcggcaacagcgtggacggcggtgcggcgctcaaccccgcgatggggaacacgtgcgtcaccgacaccggctcgcacgcgggcgacggccacgactacgggcgctacctcagccccgagaacgccgaggccttcgagcgctacctcgacgagcgctcgggtcggcacgcggtgccggagcagcgccacgagtcgccgcgccacgcgggcgggtacgagcagccccggcaggaggagtcccgcctggagcagccccggcaggacgggccgcggcacgcgaagccgcgccaggaggagccccgtcacgagggcggctacggcggccccggtgagcaccggggcaaggaggagtgcgacgaccaccccgagtcgtccccgccgcccccgccggcgcaccacgctcccccggcgcccgagcggccgcaccccatgccggaaccggtccatgaggcgcccgcgccaccgcccgaggcgccgcccgcaccccccgtgggactgcccccggccggggaggcaccgcacacgctccccgccccggagcccgccccggcaccggccgaggaggctccgcacacgctgccggcccccgcgcccggcccgcctcccgtgatggaggagggtccctccgggcccccgcacggcagcctgcccgtgcagcacccggcccctgctccggccccggtccccgaggtcgtaccgcccgcggaccagccgccggccgcccccgggggtgacaccccggtcgtcctcaccccggccccggccccggctcccgccccggtgccggctccggctccggcgcccgcgcccgtacagccgccggcccccgctccggcgcacgtgaccgggcccatgctggccgagaccggtgcgggtcagcccgcggtcgcggcggccctcgccagcgccctgatcctgggcggcgccattctgtaccggcggtcccggatctcctgaccggcaataccggtaatcggaataaatagcggccggagaatccccatcggattctccggccgctgtcatgccctcatctatgaccgtgtgcccgttcgcgtttccgcagcggccgggaatcgttacccagggtgaaagtggcgcgacggtcgccacggtcgcctctgtcaacgaaagaagaggatttcgataatgaagctcacgaaggtcgccgctgtcgtcgtcggctccgtcgccgccctcggcgcctccgccaccgccttcgccgccgagcccgcggccgcgatgccccccatgagcctgaccggcggggtgacggagacgctgaacgccgtcgggccggtctccgagtcccttccgcagaccgtgggcaacgggctggccgagcagggcgacaccgtcaacaaggtcgtgggtaccgcccagaaggtcaacaaggtacgcaacgacgtgcccggcaccgtgctcggcctcgccaacggcgccacccggacgtcccccatgctcggtggcgtgaagctcaacggcggccagggctgaaccctcccggtcggccacccgccgatacgactgtgggcgccaccggcaaggccggggcgcccacagtcggttgtgcggcggacgtcagtggttgaggcagacgttgccgaacgccgggttcagcaggccgacgatgttcacggtgttgccgcagacgttgaccgggacgtgcaccggcacctgcagcaggttgccggacaggacgccgggggaacccacggccgcgccttcggccgacgagtcggcggcggcggagccggcggcaccggccgcagcgagaccagcggtggccagaaccagggcggccttcttggcagagttcatgggaagtgcaccttctgttcgatgttctgccccgaaccggggctcacaccgagcgaaacggtccagcttcccagacgacacggtcacgcgcacgatgagacctgttcggctcaattgtcgtaaccattcgacgggttaccggccggcaccggcctacggcagggccggaagctccgggagggcgggcagcgcggggacggccggtaccgccggggcggcgggtaccgcgggggcggccggcaccgcggccaccgggggaaccaccccgtcgagcggcggaagctccaccggcggcagctccgggatgaggccggacaggtccggaagctcggggagcttgatctccggcagcttcggcagctcgatcggcggcagcttcaccccgtcgggcagcagacccccgaccgtcgcgagcaggccctcaagggtcttggtgagtcccgccaggaggtcgtcgatgggacctgcggccgccgcacgccgttcgatcttctccacctgcttctgaacggaggccacccgttcggtgagggccgcagagccgccaccctccgcggcgaccgcgggggcagccgcgccggacagtatgacgacggcgagggccgacgggacgaggaggcgggcgcgggacggcttcgtgcggtgcatggatgttccttcgtggtggggacacgaaagcggacccgaacgatccgcttcatcacccaccgtgcgaatacctcgcacggagtgcaaccggagccccggtggatgctggctgcgtacgggcttcgcgcaggcgtccggaggccggtcaccctgggcggggaaattccgagacgcgcaggccgtttgagtgaagcagcggaaccaacctcccggcggggcagttgaccagggcgctccatcagcgggcactcgtgcgacagaaggatcaagatgttcaagaagttcatgaccgccgccgcggtctccgccgttgcgatcggcgcgggcgctgccgccgcggccccggccatggccatcggcaacgacaacggggtcaacaccgtcaacggcaacggtgcccagcagatctacggcaaccagaagacccacggcgacatgagcccgcagctcagcctggtccagggcaccctcaacaagccctgcatcggcctgccggcgaaggtcaacgcccagtcgctgatcgccgcgctcaacatcggcgtccaggacatcaacgtcctgtccaacccgcagaaccagcagtgcaccgagaactccacccaggccaagggtgacgagccgctctcgcacatcctggacaacatcccggtcctgtcgggcaacctgtcgagcggcagctgatctccgactcctccgcccttcgggtgatcgcgggccgctgagcctgtggagtgaaggacgagggccccggcggcgtccagccgccggggccctcttcgcgttccgcccgcggcggtcagccggtccagaagtcccaccagcgggtgaggaccagcatgccgatcactccgatgtgcagggcgggcggggcccatccgaactcggtgaagaagccgcgcaccgggccgggagcgggcaggacgcgcgtgcggacgttgtgcgcggtgaccgcccagaacatcagcagggtcgcgacccaggccaggcagcaccacaggcagagcgcgttgatctcgtagagcgactggaccatcagccagctgcagaatccgacaccgaagagcgtgccggcgttcagtccgagccagaaccagccgcggtggcgggcgccggccagcagacccgcggcgacgcagatcacgacggcgtacccgacgagccccatcatgggattggggaagccgaaggccgccgcctgctcactcgtcatcacgctgccgcaggagacgaccgggttgagactgcacgcgggcttgaagtccgggtcctccagcaggaggaacttgtcgagggtgatcacccacgaggccagcagcccggccgcgccggtggcggccagcagccaggccaacccccggggtgcggcgccctgttcgccgtcgtgtccactgcggggccgtacctgctggcgcgggaggcccactgtattcgttgccatgcgggccatagtcccgcgcttccgcccagatcgggcccaaccatgctcatccgtatgcaagttgacctgaaaaggtggcgggaacctccgatgcttcccggacgttttaccgaaccccggacgtgatgtcagaaccaggggttacgttgagcttccgctgagtgacgagctgcgacggcctggagacccaccttgagcgatccgtacgagacaaccgaggcgcacctcgaacgactcctcggccgcgccctcaactccttcgacctgccggaccggctggtcgagcgcctcggcacggcgctcgcccacagctcgtcgctctacaccacccaccacagcccggaggcgggtatctggcgggagacccaccggcacacctatctgctgaccgacggcggttcggtctcgctgtgggagctgacctaccggctggtgggcgaccgggccgtccggcacgaggtcttcgcgagcaaggccgagacctgcctggccgtgacccggctgttcggcgaggcacccgccgcggcgtccccggatccggtgctggtgccgggcgaggaggagccggagggcggggtggcgctgctgagcgtgctgtacgcggccccggccccggtgcggcggcaccgggagtacgcggtggaggactccgccgaccacgcccggcgggtgctgcgccgcgcggagaacaccgaccggccgggcgagccgatggtgacgctgctgcggtccgcgtacgcacaccagatcactcaggcgttcggtgcccggcagtgcctctcggacgggcggggcgcgggtttcagcctgtacgagcacgccttcgtcctgctggacgggaccgaggtcagcctgtgggaggtcgagcacacggcgacgcccgacgggcggcacatgtgcgaggtgtacgagagcgaggcggccgcacgcggagcgatggaagtgcgcgcccgcgtacggtgatccggcgcgcccggcaggacgccctcagggggtgccggggtcggcgagctggaggtccaggggcgggtcgtcggtgacgcggacccggtcggggcgcagatccgccggggacggcatggcgccgcccggcagccggacggcggcagtgccgtgggccagggcggaggcgagggcgccggggccggtgccgcccgcgatcaggaagccggccagtgaggcgccgtccgccgccgcgtcgcggcgccccgccggggcgggggcggcgccgtggtgggcgccctccgccgagaccaggagccggccgtccccgccgagggaggccagtacggctcccgcgcccagctcgcggagctcctcggcggccttgaccacgtcccccagggtgggcagcgggcgtcccaccgcggcggccagctccgacgcgtcggagtggatcacctccggacgggccgccagcgccccgtgcagcgcggggccgggggtgtccaagacggtccgggcgcccgccgcgtgggcgcgggcgaccaggtcggcgcaccaccggggcccgaggccgggcgggaggccgccgcagcaggccacccaggaggcttcggcggcggcggagcggacggtgtccaggaggagggcggattcctccggggagagtgccggaccgggcaggtcgatctcggtacgggtgccgtccggttcggcgagcgcgatgttcgagcgggtccggccgacgatcgacacggccgtgacgtccacgccccgcgcgccgaggagttcggcgagcaggacaccgggggcgccgccgagcgggaggaccgccgtcgtgcggacgcccgcggcggccgcggcgagggagacgttgacgcccttgcccccgggggcgacccgttcgccgtcggcgcgcagcacccggccgcgggccggcgaggggacctcataggtccggtcgagggaggggtcgggggtgacggtgaggatcacacgaacacaacttccgtacgtccgcttcattccctaatgggcgatttcgcaccactgtacgcagaccccgggcggaaacaaaaaggaacggacacgcccgcccgggagggcggacatgtccgtgcggtcctgcccgggaaggcccggatccggctcagccgaccgggatcttctcgggggtgcggccggcatgctcggcggcgccctcgcgctcctccatcgggagcgccctgcgcggcagtacgaacatcagagcgaagatcgcgaccagtacggccacgacccaccacagcgcgccgcggaaggcctccacgtacggcgggccgaagaccatgtcgtcgtcgatcagaccgaagaagacgaccgaggtcagcgcgagacccagcgcgttgcccatctggccggtggtgttgatcaggcccgaggcggatccggcgtgctcgcgcggcacctcggagaggacggtgtcgttcagcggggccacgatcaggcccatgccgatgcccatgacgatcagcggggcggccatctgccaggaggcaatctccatgccgtagtgctgcgactcccagatgtagaggagcagaccggcggccatgaccagcgcaccggcctggagcaccttgcggccgaagcgggggacgagcttctcgaccgagaggccggcggcgaccgagaccgcgatggagaacgggatgccggtcagacccgcgcgcagcacgctccaaccgagacccatctgcatgtacatcgtccagaccaggaagaagatgccggtcgcgatgccgaaggtcagctggacggcgataccgccggcgaagctcttgaccttgaagagggagagctccacgagcggggagccgtccttcttgatcttgtacttctcgtacgcgatgaaggcggcgaagacgaacggcgccgcgcccatgcagacgaagccccacaccggccagtcgttctcgtggccgtgggtcagcgggaagatcagcaggaccagggcgagcgtggcgaggacgacgccgaccaggtccagacgcagcgccctgggggccttggactcggcgatgaacttgcggcccaggatcacgcccatgatgccgacgggcaggttgatcaggaagatcgggcgccatccgaggccgaagaggtcccactcgatgagcagcgcgccgagcagcgggcccgagacggcggcgaggcccacgatcgcgccgaacatgccgaagaccttgccgcgctcctggggcgggaaggtcacgtggatgatcgccaggacctgcggcaccatcagggcggccataccgccctggaggaggcgggccacgacgagcatgtccgggttggccgcgatgccgcagagcagggaggcggcggtgaacccggcgataccgatgaggaagacccgcttgcggccgtagatgtcaccgagacggccgccggtgatcaggcccgcggcgaaggcgagggcgtagccggcggtgatccactggatcgcgctcgtggaggcgccgaagtcctcacgcatggtgcggatggctatgttgacgatcgtgacgtcgaccaggtccatgaaggccgcggtcatcacgatggcgagcgccagccagcggcggcggtcggcgggtgagctgggtgcgtcgtgggctaggtcgttccgctcttcttgtacgggcccgttctctctttcgggcgatgtcttggacgtctcggtgctcatgaggagaaacttagacggcgtctaggtcagtctgtgtcctatttggctggcagcctggattcatgaccgacacccccgcacggctgctctccctgctgtccctcctccagaccccccgcgaatggcccgggagcgaactggcgcagcggctgcacgtcagcgcgcggaccatccggcgcgacatcgagcggctgcgggacctcggctacccggtggaggccaccctgggcgccgagggcggataccggctggtggcgggggcggcgatgcccccgctgctcctcgacgacgaggaggcggtggcgatcgcggtggggctgcgggcgggggccgggcacgcgatcgagggggtcgaggaggcttccgtccgggccctggcgaagctggagcaggtactgccctcacggctgcggcaccgggtgagcgcgctccagtcggccacgatcgcgctgtcccggggcgacggggcgagcgtggacccgcggacgctgaccacgatggcggcggcggtggcggggccggagcggctgcggttcgcgtaccgggcgggcaacggcgccgagacgcggcggctggtggagccgtaccggctggtgagcaccgggagccggtggtacctggtcgcctacgacctggagcgggaggactggcggaccttccgggtggaccgggtcgacgaggccttcgcgacgggggcccggttcgcgcggcgggagctgccgatggaggcgcaggagttcgtcctccgggggctgcggggcggggagaagcagccgtaccgggtggaggccgacttcgcggcggatccggcggagctgccggcctggctccgggccgcggcactgccgggtgacgggacgcggacctcggtgcggttcgagagcgcggacgccccggagtggacggtggcgcggctcgccctgacggggttgccgttcaccgtgcgggagcctgcggcgcttcgggatgcggccggtgcgctggccgcgcggctggccgtggccgctgcgccgtagccggaggggctgggtcgtgcggggcaggagagagccccggcgcctggggggataggcaccggggctcgtatggggggcttggcggcgggccgctctaggccacggcgtcgaagccggtgtcgcgcgccatccgcttcagctccagcagggcgtgcttctcgatctggcggatgcgctcgcgggtcaggccgtgctgcttgccgacctccgtcagggtccgctcgcggccgtcctcgatgccgtaccgcatcttgatgatcgacgccgtgcgctggtcgagcttgcccagcaggtcctccagctcctcgctgcgcagcagggagagcacggactgctcgggcgagatcgcggaggtgtcctccaggaggtcgccgaactgcgtgtcgccgtcgtcgtcgacggacatgttgaggctgaccgggtcgcgggcccagtccagtacgtcgcccacgcgcttctccgtcgagtccagctcggcggcgatctcggcgtgctccgggtcgcggccgttctcgcggttgaactcacgctggatgcggcggatccggccgagctcctcgaccaggtggacggggaggcggatggtgcgggactggtccgcgatggaccgggtgatcgcctgccggatccaccacgtggcgtaagtggagaacttgaagcccttggcgtagtcgaacttctcgaccgcgcggaccaggcccgcgttgccctcctggatcaggtcgaggaggggcaggccgctgcggggatagcgccgggcgacggcgacgacgaggcggaggttggagcggatgaagacttccttggcgcgctcgccctcggcggccagcgcctccagctcctcgcgggccggggtgtccccgtcccgctctatcgcgccgtcgaggatctgctgggcgtagacgcccgcctcgatgatctgggagagctccacttccttggcggcgtcgagcagcggggtgcgcgcgatctcgtccaggtacatgccgaccaggtcacggtctgcgatctccccgcccacagcgcgagcgctgctcgtggactgacgacgggcgacggcgcgggttgccatgcgtgctcccttgcgaagtgttcggtcgcggtgcggctggtggacgccgccgggacggctgccaaccgctccggaacgtcacggacactctcccgagtgcccccttccgaaggaaacaacgactggaatcgggacagaattcccacgcggctccctctttttcgagatcttgcagtatcctgccccgccaccagagggggagcggatgacacaagatctcgaagaggtgcaggtcaggcccggaacggaagccgatctggcgcccctcacggacctctacaaccactacgtccgtgagactgccgtcacattcgacacggccgttttcactccggaacagcgccgcccttggctgcactcccaccctgaagacgggccgcaccggcttctggttgcctggacaggtgatcgaatggccggatacgccacgagcagcgcattccgccccaaaccggcctacgcctcatcggtggaggcgagcgtctacctcgccccgcacgcggtcggccgggggatcggcacgctcctctacgaggcgctcttcgcgaccctggccgaggagcccgtacaccgcgtcttcgccgggatcgccctgccgaacgaggcctcggtgcgcctccacgagcgcttcggcttccgccgggtcggagagttcacggaggcgggctggaagttcggccggtactgggacgtccgctggtacgagaagcgcctgggccaccacccgtccggctgaggggcctggcatatccctgcggcatgagcccacccctccctaccgtcggggcgtcgcttgtgcggcccggccggcgacgcccacactttgaggaggtgctgcacatgaccgctctcgcccacgagacgccggaggccggaatgacgaaggtcgcgactcccccgtcggacctcgacgacgtcctgtggcaggcatggcgagccatggaactccccgagggctatcacgccgagatcatcgaggggtccatcgaggtgtctcccacggggcgctacgcacacggcaggatcgtcaatgaactgagggaccggctggtcgtcttcctcgcgaagagcgaattcgccgcccgtcaggacatcaacgtgatccacaggcgaaaggtctggatcccggacctgttcgtcgttccggcggacgcggaggagtacgtgaccgaggacgggctggggatcgacgcctccgccgtcggactggtcgtcgaggtggtctcccccggcagcgagagcatcacccgagaccggacccgcaagcgcagctcctacgcgcgcgcggggatcccggtctacgtactcatcgacgactacgacgagaacggcatcgtcaccgtgctcaccgtgccggaacccggcaagggcgtctaccggaacgagctccggacggcctacggcacggccgtcacccttcccgaggggcccgcccagggattcaccatcggggtggacgtcaccgggatcgggcggcagggctagccgaactggagggagcgcttcgagaggcccatccagaagccgtccaccggggtgcgggcggaggccaggtcggattccgccgcgccgagggtgacgaagagcggggcgaagtgttccgtgcgggggtgggccaggcggcccgccggggacttgtgctcgaagtccagcagggcgtccacgtcggacgccgccagggcctcgcggccccacgcgtcgaactccgccgaccaggcggggacgcccgggcccgtatggcgcagcgccgccaggttgtgcgtgaagaagccgctgcccacgatcagcacgccctcgtcgcgcagcggggccagcttgcgcccgatgtccatcagcgcggccgggtccagcgtgggcagggagatctggaggaccgggatgtccgcctccgggtacatctccaccagggggacgtacgccccgtggtccaggccccggtcggggatgtcctggacgggggttccgggggcccgcagcagtttgcggaccgcggcggccagctccggggcgccaggggcgtcgtagcggacctggtagtagtgctccgggaagccccagaagtcgtacacgagcgggacgcgctccgtggcgccgagggcgagcggggcctcctcccagtgggcggagaccatcaggatcgcgcgggggcgcggcaggtcggcggaccaggcggcgagctcgcccggccagagcgggtcgtcggccagcgggggtgcgccgtggctcaggtacagggccggtatgcgggtcacagggggcgctcctccgctagttgaaatgcgtactgaaacagactaaccccgtctcgttcaaatttgaacgagacggggtcgtcagtcattccccagtcattcccgcgggcccccgaagggcctggtcagtgggcgatcaccgggaccttgagctcggcctcctcgccggaaccggaggccacggggccgccggcgcccggacggccggtgttgatcagcgtcagcgcgatgaccgagctggcgatcaggatgccgaccgcccaccagatggcggacgcgtagccctcgaccatggcctgggcctggatcagctgcccggccgggccgcccgccgcggcctcggccgcgtggtcggccaggtaggcggtggtcgccgaggcggcgatggtgttcagcagtgcggtgccgatggcgccgccgacctgctgcgaggtgttgaccatggcggaggcgacaccggcgtcggccgggttcaccccgtgcgtggccagggacatcgccggcatgaacgccgtacccatgccgaggccgagcagcagctgcgccggcaggatcagcgccgggtacgaggacccgacctccagctgggtcagcagcagcatgccgagtccggcgaccaggaagcccgggcccatcagcaggcgcggcgggacgcgggtcatcagccgggcgccgatctgggtggagcccgtgatcatgcccgcgatcatcggcaggaaggcgaagccggtcttgacgggcgagaagcccttcacgacctgcaggtagtaggtgaggaagaggaacaggccgaacatcgagatgacggcgaggccgagcgagaggtagacgccgccgcggttgcgctccagcaggacacgcagcggcagcagcggggacttcaccttggactcgacgaggacgaacgccgccagcaggaccgccgaagcggcgaacatggccacggtgaccgcgttcgaccacccggccgactcggcgcgggtgaagccgtacacgagggccacgagaccggtggtggacaggaccacgcccgggatgtcgagcggcgcgcggttgcgggacccggcgggctcgcggatgaccatccaggcacccgcggccgcgacgatcgcgaaggggatgttgacgaagaaggtccagcgccagttgaggtactcggtcaggaagccgccgaggatcaggccgacggcgccgccgccacccgcgatggctccgtagatgccgaaggccttggcgcgctccttggcgtcggtgaacatgacggcgagcagcgacagggccgccggggcgagcagcgcgccgaaggcaccctggagggcgcgggcgccgagcatcatggcctggccgttcgcggcgccgccgagcgcggaggccagggcgaagccgatgaggccgacgatgaaggcgttcttacggccccacttgtcggcgatgcggccgccgaagaggagcagtccgccgaaggccagcgcgtacgcggtgatgacccactggcggttggcgtccgagatgccgaggtcggtctgggcggaggggagggcgatgttcacgatggtcgcgtcgaggacgaccatcagctgcgccagggctatgaagacgagtgccttccagcggctgggatcggcggccggcgcgagactcgcggcggtttttgacatggaggtacccactcactgtgcggaatgactgaaaaaggctggtttctaagctctgtgcgcgtcacatggttttctgccgcaggtcgtccaacgtggccgccgaaccggggagttcggagtgggccggggctcgcaacccgtcgaggaagagctggagatgacggtgggcgaagcggtcggtgtccaggcagccggtacccgggagggggcgactgagctgggagagggccaccatcagatcaccggcgccgatgtccgtgcggaccagtccggcgtcctggcccgcggtcagcagggtgacgacggcctcctccaacgcggtgcgcgccgcgaggagttcggggtgctcgccgtcgaagccgtcggcgagcatcgggcacagggcgccgatccgctcgtcggcggcggcgtgcgtgaaccggcacagggcggcgaaggcgtcgggctcctcggcgagggaggcctcggccgaggccgtcacccggcccatcgtgaagagaacgacgtggtggacgagggtggggcggtcggggaagtgccggtagagcgtggcattgccgatgccggcccgacgggccacctcgtcgaagggggcccccgagccggattcgacgaaggcctcgcgggccgccgccagaatccgctcgcggttgcgcacggcgtcggcgcgcggccgcgggacggccgtcgccgcgggcgccggggtcgaggtcggggtcggcgccggggtcgggtccacggtgaccgcgggggcgggccgggccgccggggcgatgctggtggagctcttcattccggggcctccctggcgcggactcgtgggcttgcgactcggccaccccgaccaaacggggagccgctccccgcttagcgggactcacatgcaaacggggatccggtccccggttatttcacccccgcgtgtgacctgagtcaccggcgtgtccacgttcggcctcttccggcgcgcgggcgcgccacgcccggcggagggtgatcgaacagagcgcagaccgggcagggccggctgccgcggacccgaaggcgatctccatgccgcagacccgccaccggatacgcagaccatgccgcaccagcgcgtacatcggcctgaccgcgctggccctcggcgtcacgacgacggcgagcacgggcatatccggtcgcggcaactcggcggccggagcggtggccacgaccgtcgagtcggctctcgcgccctgccggatcgcggggaccatgggggtgcagatgtccgaggggatgccgaccccgcccgggtactcgcgctcgaccggcgagatccgggccctgaacctgatgatcgacttccccgacgccaagggcgagggcacggcggcggaccggatggcggagttcttcccccagacggccgaatggttccgcaccagttcctacggccggctggcctaccgggccgaggctccgataaagggctggctgcggatgccgatgcccttcgccgcgtacgggatcgagcgcgggtccgcgtacgagccgggctaccggcagctcgtcgagcacatagcgaaggccgccgatcccgaggtggacttcgcccggtacgacctgatcaacatcctggtcacgccgaacgccgggccctccgccctggacaccgtcctgtcggtgaccttctcgggcaacggtgaggcgccggtcgccgacggggtgccgctggccaacacgtccttcgtctacagccggcaggacgacggctccggcacctaccgggagaccggttaccgggtgctcccccacgagaacgggcacgtcttcggactgcccgacctctacacctccgacggcgggagcacggtcgggcactgggacatcatgagcgaggactggggtgccaataacgacctcatgggctggcacaagtggaagctgggatggctggacagcacgcagatcagctgcgcggccaagtccggcaccagcgaccacaccctggccccgctggggacacggggcggcaccaagctggccttcatcccgctgtcggagagcgccgggtacgcggtggaggtgcgcacccgggccgggaacgacgaggccgtctgcaagccgggcgtcctcatctacaaggtggactccgacgtggacaccgggcacggcccgatcaccgtgtcggacagcgcgagcacgagcggcggctgcacccggcggcccaatgtgcacgcggagctctcggacgcgccgttccggccgggcgagaccttcaccgacgagaaggcgggcatcagcgtgtccgtggtgggtgaactgcgcaacggcagttaccaggtccgcatcatccggccctgaccacctcccgccggggtcccgccgggccgggacgggaccggagggccggagtgccgggtgccacgtggctccggccctccggtcagtcctccgcgagcgcccggcgcagtacgtccacgaccgtggggcggtgctcggcggccagcaggaagaagtggtcgccgtcgaaccggtgcacctggcacgccccggtcgtgtggccggcccagccgtccagcggctcgtgcgggaccagggggtccgccgtgccgcccagcacgtgcaggggcacgtcgagccgtacgtccgcgaaccccgccgcggcctcccggccgagttcgaggtccgcccgcagcacccgcgtcacgtgcgccagcatgtccgggtcgtgcagcacccactccggcgtgcccccgccgtcccgcagcagccggacggcgtcctggtcggtggtggccgcatgggcccggcgcggggtccggccggggacctgcccgctgacgacggcggcccggcagtgcgggccgagcaggcgcgcggcgcgggtggcgaggagcgcgccgaggctgtgcccgaagaccaccgtgggcagcgggtcacggccgagcacctcgtcggccacggagtccaggacctggtcgagccggcagccgggcggctcgccgaaccggcgctcccgcccgggcagcgagagccccagcacctccacatggccgggcagcggctcgaccagggggaacagggtgttggggcccgccccggaatgcgggaacaccaggagccgcgcccggggcgcgggtgcctcgcgcagccgcagcagcggccaccacggcacgtgcggggatgccatcgcccccggtccgccggggccggtcacgggcagttgatgatctggccggcgtaggacaggcccccgccgaacgcgaagagcagcacgggcgatcccttctcgatctcaccccgctcgatgagtttggacagggccagcgggatgctcgcggccgaggtgttgcccgagtcgacgacgtccttggcgatgacggcgttgaccgccccgatcttgcgcgccaggggttcgatgatccgcaggttggcctggtgcaggacgacaccgcccagttcctcgggcttcacgccggcccgctcgcagacctggagggcgacccgcgggagcgccgtggtggcccagcggtagaccgactgcccttcctgggcgaaggtgttggagggcgcctcgatgcgtacggcccggcccatctcgggtacggacccccacacgaccgggctgatctccggctcctcggaggcgacgacgacggccgcgcccgcgccgtcaccgatgagcacacaggtggtgcggtcggtccagtcggcgaagtcggtgagcttctccacgccgatgaccagggccttcgtggcggagcccgtccgtatgctctggtcggccagggccatggcgtgcgggaagccggagcaggccgtgttcacgtcgagggcggcgggagcctgcgctccgaccgcggccgccacccgggccgccgtgttgggcgagcggtcgagcgccgtacaggtggccacgacgacgaagtcgatgtccgcaccggtgagtccggcgttggccagggcgtgctcggcggccttcgcggccatgtccgcgaccgactcgtcctcggccgccacccggcgcgtcctgatcccgacccggctctgaatccatgcgtcggtggtgtcgaccatctgctcaagttcggcattggtcaagacttttgacggctgatagtgcccgaaggaaaggacacgcgatccgctcatcagtgtgtttctcctcgctccgtggacccccggtacggatcctgatcgaccgatgatcagactatgcagcggccggccggggcccgtccccgagaacggtcggttttctgccgtacaacccacgcatccggccaggcccttcccggtcccgcgttcttcccggtcctttgtatccgccgtgtatcggccggcgctcgggtgccgatcggatcgcgcgcccggccccggcagcggttcccgcgcccggcgcctcccgtatcgttcctttccggtcgccggccgcagcgtgtgtgggtgcatgccggaacggcgctccgcccggcccgtacgaacaggagtcccgcccgtgccctcgcccgccccggccccggaatccccgccgccggtccgcgtgctgctggtcgaggacgacgagctgatgcgccggtccttcggcgtcgccctcgggcgctacggctaccgggtcacggccgcggccgacggactgaccgggctggagcacttccgcgacgacgacggcttcgacctgctgatcctggacgtgatgctgcccggcctcgacgggatcgggctgtgccgccgggtccgcgagaccagcctggtaccggtgctgatgatgtccgcccgcggcgacggcctcgatgtcgtcgccggcctggaggccggcgccgacgactacgtggtcaagcccgtggacacgtacgtactcgtggcccgcatccgttcgctgctgcggcgggcggcctacgcacccgccccgggcaccgcgaccgccgccggccaggacggcgtactggtcttcggggacctcaccatcgacaccggcgggatggaggtgttcctctcgggaagccccgtggcgctcaccccgaccgagctgaaactcctgctggagttcgccgcccacccgggcatcgtgctggaacggcacaccctgctgcgcaacgtctgggagtacggctgggacggtgacagccgcgtcgtggacctggccgtacagcggctgcgcaagaaactgggccgggagcggatcgagacggtccgcggcttcggctacaagctcaggcgctgaggccggtgcatcccccgcaccggccgtggtggccggcccgtgtgcccctgcgctggaagatcgccgcgctggcggcggccacggcctccctggtcgccctggcggtgggcgtcctcgtccacctgtggaccgcgatggacatccgcgaccgggccgagatggaagccaccaacacggtgtactccgccatggacgtctaccggcgcaccggaacgctgccgggcggcgccgagctcgatccggccgacctgccccgcgcactgcgccacccggccgacggcgaccggcgggtggcctacgacgggcgcgtcgaggggaacctcgggccgagcgtctggggcacccagcgggtcggcggcccgggcagcccggtgctggccgtccggatcaacatgagcccgcagctgtacgacctgcgccgcctcgacgcgagcgtggcggtggcctccctcgtctcgctcgcggcggcgctgcccctggcggtctacggggccgggctggtcgcccgccgcctgcgccgggtcgccgggaccgcggcccggatctccgccggggacctcgacgcccgtaccggccccgcactgggtcgggccaggggccgcgacgaggtgaccgacatcgccgccaccgtcgacctcatggccgacagcctcggccgacggctgcgcgtggagcgtcagttcacggcggacgtggcccacgagctgcgcaccccggtcggcggtctgctggccgccaccgacctgctgccgcccggcgagacggaggacctgctccgggcccgcgtacgggatctgcgcgccctcgtcgaggacctgctggagatctcccggctggacgcgggcgcggaggcgccggtacgcgtccgggtcccgctcgccgcggtggtcgccgaggcggtggcccgcaccggcctcgacacggaggtcaccgtcaccggggcgccgcacgggccgcacgggtcgccggcatcggccggggagaccggggagactacggagaccgtggagaccgatccgcgccgtctggagcggatcgtcggcaacctcgtcgtcaacgcgcaccggcacggccgcaccccggtgcgggtcaccgtcgagggccggaccgtcgtcgtccgcgaccacggccccggtttccccgccgacctgctgctcgacggcccgcgccgcttccgtacgggcgccgcggagcggggcgcgggacacggcctcggcctgaccatcgccctgggccaggcccgcgtgctcggtgccgaactgcgcctggacaacgccccggacggcggcgcggtcgccaccctgcggctcccgcactgaccgaccggccgcccggccgccccacacgactgacgcgcaacggcgcggaagccgatacacgcccgccccggccctgatacgtccccccgacacccttcggcgtgcacccctttcgcaccgcacgcacccgaagtggagtccccgtgaccgccgaccccttctcctcccgaccgatgcccggtatcgcggcctccaccaccgacctgtcgaaggtctacggcagtggcgacacccgcgtggtggccctggagggagtcagcgtctccttccgggaggccgagttcaccgcgatcatgggtccctccggctgcggcaagtccaccctgatgcactgcgccgccggcctcgactccgccagttccggctccgtccgcatcggcaccaccgaactgggcccgctgggcgaccggcagctcaccgagctgcgccgggaccgggtcggcttcatcttccaggcgttcaacctgctgcccaccctgaccgcgctggagaacatcaccctgcccctgtccatcgccgggcgccgccccgaccggcagtggctggaccgcgtggtgtccatggtcggcctcggcgagcggctggaccaccggcccggacagctctccggcgggcagcagcagcgcgtcgccgtggcccgggccctggtcacccggcccgcgatcgtcttcggcgacgagcccaccggcaatctcgactcccgcgccggggccgaggtcctcggcttcctgcgcgactccgtgcgcgaactgggccagaccgtggtcatggtgacccacgacccggtcgccgccggtttcgccgaccgcgtcgtcttcctctcggacggccggctggtcgacgagatggtgcaccccaccccggaccgggtgctggaccggatgaagcagttcgacacccgcgcacgcacgagctgacccgcccctcccctgtcaccgccccggaagccactcaccatgctgaaaacagccctgcgcaacgtcctggcgcacaaggcccgactgctgatgacggtgctcgccgtcaccctcggcgtcgccttcgtctccggcaccctcgtcttcgcggactcctccacggccgcccaccgggccgctctgtcgaaggactacgccgacatcgcggtcaccgtgaccccgaaggaccccccgcccggcgcggcttcggcagccgggcccgccgggtccgccggggacgccgggcccgccggggacgccggggacgccggggacgccggggacgagcacgccaccgtgctcgacgacgtcctcgcccgcaaactggccgcactgcccggcgtcgccgccgtacggccgtccgccgacggcctggccaccctgaacgccgcggacggcagcccgctgcgcaccggcaggacctgggcgcaccgggcggccgcctacgtccccggcgccgacggcaaggacggccgccacccgctgaccgagggccgcgcgccccggggcggcgatgagatcgccgtggacagcggcaccgccgccgccggccggttccgtatcggcgccgagatcaccctggccacggacggcccggccatgaagaagcggctcgtcggcatcgtcaccacccgggacacccgggtgacggccggcggcaccctcgccctgttcgacatggccaccgcgcagcagttgttcgcctccccgggccgctacacctcgatcgacctgtccgccgcacccggcaccggcgaggccgaactctcccgccgggtcgccgcactgctccccgccgaccgggccgaggccaccaccggcaccgcccaggccgcccagcaggccgtcctcgtcgacacgctcacccgcggcaacgagaagctgtcgctggtcttcgccggagtcgccctcttcatcgggtcgttcctcatcgtcaacaccttcaccatgctcgtcgcccggcgcacccgtgagatcgcgctgctgcgcgcgatcggtgccacgcgccgccaggtcgtccgctccctgctgtgggaggccgtcctcctgggcctggccgcctcggccctcggtttcgtcctcggcctcgggatcgcctccgtactgccacggatcctgggcaccgccggggagtcgctgccccgcggccccctggtgatcggcccgctccccgtcatggccgcgctcgccgtcggggtgggcatcaccgtgctcgccgcgtggctgccgtcccgcaaggccgcgcgcatcgctccggtcgaggccatgcgcgtggccgaacagccgcccaccgccgcctcctcctgggcccgcggcgcggccggggccctcctgctcgccctcggcgccggactgctgctgtcgctcgcgggggcgaaggacgcctccgaggagaacctgcggagcgcgatgtccggctgcgccctcctggtcgtcgccgtgatcgtgctggcgccgctcctcgccgtccccgtgatccggctcggcggacggctgaccggccgcctcgggatcgccggccacctcgcccaccgcaacgcgctgcgcgacccgcggcgcaccgccgccaccgcctccgccctgatggtcagcacggccctggtcgccgggctctccgtcatcggccattccaccggacaggccctcgaccgccgggccgcggccggcctcggcgccgactacgtgatcagcacccacaccgcctcggccggcatcgacccggccgccgtgcaacgggtgaccgccgcccccggggttcggacggcgaccgccgtcgccgactccaccctcttcatcggtggtggcgtccgcgagatctccggggtcgatccggccgccgccccgtccgtgatgaagctggacttcgtcagcggctccctcaaggacctcggaccgggccgcatcgccctctcgcgcaccctcgcccgggagaacggcgtgagcaccggcggccggatcgacgcccggatcggcgggcccggccaggacctcgccccgtacacggtcgtcggggtctacgaggacaaccccaccgcccgcgaagcgctgggcgcccgcaccgaggtccagcggaacagcctcacccccggctccgtccagcgtgtcctcgtccgcaccgagggcggcgcccacgacggggccaccgaggaccggctgcgtaccgccaccggcgagaacccgctcctgaagatccaaagccggaaggaactcgtccgggaggccgccggttccctgagcaccctgctgaccctgacctacggactgctcgtcatcggcggtgtgatcgcggccctcggcatcatgaacaccctcgccatgtcggtctcggaccggacccgcgagatcggcgtcctgcgcgccatcggcatggaccgcgcaggcatccgccggatgatccgcctcgaatccctgacggtggccgccttcggcaccctgctgggactgacgaccggcctgttcggggcctggacggtcggcgcgctgaccaacggcgcgctgaagggctacgcgttggccctcccttgggacacgctgcttctcgtctgcttgatctccctcgccacgggcgtggtggcggccgcgctcccggcccgccacgcgtcggccctcggccccctggaggccgtggccgagatctagggggtgtccggcggatcacggcgccaatgcgccgaaggggcccgcagcgcgagtgcggcggcgtaaccctcgggggccggcaggtcggtgagggaccagtgcgggcggacggaatcgccggccgggccggtccccaggtagttccggttgccctcgtgccccagtcccgctccggtgcccttgaggtgggcctccttgcgcgcccacaggcgggcgaacgccgcggcgcgtccggcctcggggagcgcggccagttccgcggactcggcggggtggaagaactcctcgctctgcgccaccacccgcggtgccggcagggcctcgacgtcgaccccgaccggggtggacgcgcaggcgaggaagaccgcgtcgcggctgtgcgacagggagaagtgggcgcggccgcccacgagggccggacggccgtccgggccgccgcactcgggacaggcctcgcgggtcatggccagatcgcgcggagcggtgtcgagcagggcacccagcagcagcctcagcgccacgtgcgcgacgaggtacgagccgcggtcctgggggcgtacgaaccggtcggcccggcggcgctcggcggcgtcgagcacgtcgggcgcgaggcgttccgcgaacggggcctgcgcctcggcgtccacgtaccgtacgagggcctcgccggcagcgggcggccgctgcgcccggaccggccggtcgagccgcagcgcgagggagtcgaggcccgcggtggtggtcatccggaaatcctaagcaccggtgacggcacaggcgtcagagggaagaggacgaggacgagaacgagccacgacggcgccgggccagcacgtaggcccccgcgcccgcggcgcccaggccggcggccgcgccgccgacgagccagggtgtccgtccccccgccggttccgacgccccgtcccgacacgaactgcgggtcgcctcatcggtttcggccacgcggtagcgggcccagacctcgtccctgcccacccagcggacctcgtacagacccggcccggcatcgcagcggatcgtggccgtcgccgtcacgaccgccctggccccgcgcatgacgggccggtcggtgaagcccggcgaagtgagggactcttcgttcccccgctccgaggccgtgggcgtcaccttggctccgggccggaacgtccttacgtcccacggtgattgcggccaggagtctccggcgggccagcgctcctccagctgctccggggggagggccgcgaccttcgcggggcaggccgcgcgttcctccgcgccgatgtccgcgaccgtgacggtcacccagggactgcccttgccctccccggcgtccttgccgcgcatcgtcgtctccaccgggtagacgcctggcggggtgtcacacgccacggtggccacggcggtgatgacgggatcgtccatcctcagcgtcccgtgctggacgaagatcttggaaatgacccagtccccgttgatccccggcaggtgcgggggtgccgtgaaggtgagccggtcaccggggcgggcggacagttcggcccccacgggcagcggggcgggcggatccgcggcctgcgccgcgagggcgctcgccgcgggcgtcatcaggagtaacgacagcgcggtggccccgccgatcctcatcgcgatcgtgcgcatgcggccccatttcatttccgttgacgatcttcctggtccctgcataccgtgccggacatcgaactggcgcacgaattcagctcgttgctccgccttgcacctctcctggaaagtaagagtcctttgagatccagatggttcaccgtcttcttcgcccttggcgcgatcggcgccttattgggctccgaaccggctctcgccgcgagcgccaccccgagccctggccccacccttcccctggtcggcgtccagccgcagcccgcggccaccatgacgccgaaggcccccgccaccaccgcgccgacggcccgcgccaccccgggcccgagcgccagcacgccggtcgtgcctgccgctcctgccgcgccgcccgcgccggcccagccggccacgacgccccctcagacccccgccgagaggctgcgcgccgaagaggcgtactggacggccgaacgcatggccgccgccgtgcccgtcgacgccaaacgcggccaggacccggccggaaaggccgcgggcaagctcagcgcacaggccgcacccccctcgggcacccccaccggctccttcttcgacggcatgccgatggtggggacgttcttctacggggcggactcggtcggcaaggcgaacacctcctgcaccggcagcgtcgtccgcagcgcgggcaagaacatggtgctcaccgcgggccactgcgcggacgacatgaagaagccgaacagccacgccgtcttcgtgccgcagtaccgccacggcaaagcccccggcgcccagccccacggcatcttcccggtcaaggtcaacggcgtctacatagacccccgttaccactccaacagcaagggcgcggactccgacctggacctcgccttcgcgctggtcgagccgaacggcaagggacaggccgagaacgtcaccggggcgctcaccttcacgccgggcagcacgtacgaccacaaggtcaccgtcgtcggctatccctccggttcgagcgtcaacaaggaccaccgggccttccgctgcgacgtacccaccacccgcctggccggttaccggcagatgcagatgctgtgcaacgggttctacagcggcgtgtccggcggcccctggatcaaggactacgacgcggccacgcgcaccggcaaggtcatcggcaacaccggcgggtactacggcggcggcgacgacgccaaccactcctggatcacctacgcgccggtgtacggcaaggacgcccaggacctgtacgacgacgccggcgccggccgcgacccggacaaactcccccggccgccgtaccagggacccacggacagccccctcctgcccggcctcggggacctgtggacccacgccaaggcgatggcctccggcgacttcaccggcaacggccgcagcagcctgctcgtggtctggacggacggcgaggtcaccctcttccccggtgacggccagggcggcttcctgccggagcgccagctcctggcgcccaacggcacctggaagcccatcgccaccatcaccgccggcgatttcaccggcaccggcgagttcgacctcatggtccgctgggacgacggccggatgaccctgcacggcgacgtcggctccaacggcctcggcacgtcgatcgagatggccccgtccgggtccatctggagccacgccacccagatcgccgccggccggttcaacgcctccacctacgtcaccgacctcatggtgcgctggtccgacggcgagctcagcctcttcaccaacgtgagcgccggcaccatgggccaggagtacaagctcaaggaccccaacagcacctggaaggacgccacgctgctgacctccgggcagtactccggcaaccagaagtgggacctcatggtccgctggtccagcggcgcgctcaacaactacgtcggcaccaccaccggcggcctgggcgccgagcagcccgtccacggccccaacaagacgtggacccacagtgaggtcatgaccaccggccagttcacgggcgacgggctcaccaacgacctcatcatccgctggagcgacggcgagaccaccatgtaccgggacacccggatgaacggcctgggctcggagcgcatgctcgtccccccgaggacctgaggcaccggccccggacccgcccccagccggccatcgtccaccgggccgcatcctcgcccgcggcaccccgcccgcggccgtcttccgcccttcccgggcgaagacggccgcgggttcggcttttcaggtgaccggcccaccgcacctccctcaccacctcccgcccagccgcggccacccccaggcaacttaattgccagatcttgacaccagtgtgccaatcaacaatgctcgtggggtccacgcagcatgcactggcgcgacagccagcactgttgtgctgggcagatctgacacacgttgacactaatttgccaagctggggggcagatgctctattcaggaatctcctggagcgccgacggcttcacggtggacgtcatcgacgagcacggggagcagcggcggccgacacggcggttcggaccccggcacacccacgaactgatcggctacctgcggggcttcgaggaggagccggccgccgtcgtcgacagcaccaacggggtgctcgacgggcgcatgatggccgagggtctgaccgtctaccgcgcggacccccagcacctgggcgaacgcccggtcttctcctcggtgcccgccgccgacatcgccgcggccgcgctccggggactcggcgcactgacccggctgcagcgcgaccggggcacccagaccgggcgggagggcgaccttgtggagtccgcccgcggcagcgagcaggccctggccgagtggacccggcggggtacctgcgtcagccggggcagcggtgagcgccgggagatctcgctgaccttcgacgacggcccgcagccgccctacaccgggcaggtgctggacgtcctgcagcgctacgacgtgccggccaccttcttctgcaccggcatgtacgcgtcggcctatcccgagtacctcgcccgcatgcgggaggagggccacggcatcgcgaaccacacctggtcgcaccccatgctcttcgaactgacgcggccccagctcgtcgagcagctggaccggaccaacgaggcgatcgccgcggccaccggcggccgggcacccaccctcttccggcctccgtacggctcgcgcaccccggagacgctgggctggctcgcggaagcgggactgaccacggtgctgtgggacgtggcccccgacgactgggccatgcccggcgcgggcaccatcgccaccagcgtggtcgagcaggcccggcccggttccatcgtcctgctgcacgacagcggcggcgaccgctcgcagacggtggccgccctggccccgatgatcgaggggctgctggaacgcggtttccgcatcgtcccggtcgagcagcagctgggcgcacacgcgcccgtacccgcacccgcgctcgtcggtggccggcggtgcatgcgatgaccgggacgctgagcaactgggcgaacagcctgacctacggcgcgcgccgggtgcaccggccgcgcaccgtcgacgcactgcgtgcgctcgtcgccggcacggaccggatccgcgcgctgggcacgcggcactcgttcagcggggtcgccgacaccacgggcgatctcgtacgtctggacgggctcccggagtccatggagctggatccgcaggccggtaccgtgacggtggcggcgggcacgcgctacgccgagctggcgccgtacctgcaccgggcgggctgggcgctgggcaacatggcctccctgccgcacatttcggtggccggatccgtcgccaccggaacccacggttcgggggacagccagcgctgtctggccgcggcggtgtccgcactggaactcgtcggtccgcagggcgacctggtcgaactgcgccgggacacccacccggagttcgccggcgcggtggtggcgctgggagcactgggcgtggtcacccggctcaccctggacctcgaacccgcctaccaggtggcgcagacggtctgcccggacgtgccgctggacgaggtcgccgccgacctggacgcggtgttcggtgcggcctacagcgtcagcctgttcaccgactggcgcagcggccacggctcggtgtggctcaagcgccgtaccgaccggcccgactccggctggggccgcggacgcggggcggccgcgccgatgcacccggtgcccggggtcgatcccggttccagcaccgagcagctgggcgtgcccggcccctggtaccagcggctgccgcacttcccgcccgagctcacgccgggcgccggcgaggagttgcagtcggagtacttcgtgccccggagccgggcggccgccgcgttcgccgcgctccgggccctgggcgaccggatcgcgccggtgctgcacatcgccgaggtgcgcacggtccgcggcgacgacctgtggctgagctccgcctacggacgggacaccgtcaccttccacttcacctggctcaaggacctgcccgcggtacgaccggtgatcgccgccgtcgaggagcagctgatgcccctgggcgcccggccgcactgggccaagctcaccgagaccccggccgagcggatcaccgccggctatccgcgcgccgcggacttcgtccgcctcgcggagcagcacgacccggacggcaagttccgttccgcgttcaccgatcagttcttcaccaatccgcagaaaacaatgggggtaatgcgatgacaccgaacgctcttctgctcgcccacgacaagccggccgcattgcgtcccgatcagctgcggcagttccaggagctcggctacctggtcctgcccggcttcctcgatcgggacctggtcgcccggatgaggcacgaggtcgaccggtgggtggacgacggcctgcgggcgcgttccatcgactcggtgaaggacccggagaagttcggcgtgccgccggtcatggagctggaactgcccgcccacggcgagctgatcacctggtccccgctgctggagatactcgaccagctggtgggcgcgccctacgccttccaccacctgcacagcgaccgccaggccccggacatccccggcaagccgtggcaccacgactacgagcacagcacgcagaccgaccgctccgcgaccatgatccacgccctgcactacctggacggcctgagcaccgacacctcctcgctcgtcgtgctgcccggttcgcaccgcgagcgcgtggacaagacggcccgcgcgcacctgggcaccgagccgctgcccggtgaggtcgtgctggaggagctgcccccgggcagcaccgtcgtactgcactcggcgctgttccacgcccgccggccccgcccgggtgtgctgggcaagccccgctacttcgtcgacgcctcctactgcgaggtcggcccgctgtggccgccggtcaagccgtactggcgttacatgctgcggcgggcccgggagctgaacctggcgccggaccggtcggagctgttcaccgagctgaccttcgccgagtacagcaggccggcatgagcgggcgtcccgtacgcatcgggctgcagctgcagcccgagcacgccgactacgcgacgatccggcggaccgcggccgaggccgaggcgctcggcgcggacgcgatcttcatctgggaccacttcttcccgctcaccggagagccggaaggcaagcacttcgaatgctggacggtcctcgcggcgctggccgagtccacctccacggtgcagctcgggccgctggtgagctgtgtcgggtaccgcaatcccgatctgctcgcggacatggcccgcacggtcgaccacatcagcggcggacgggccatgctcggtctcggctccggatggtgcgagaaggacttcaccggctacggctatccgttcggctccgacggcgagcggctccgggagctcgccgctgcgatcccccgggtgaagtcccggctgtcgaacctcaatccggctccggccgggcggctgcccctgctgctcggcgggggcggcgagaagcgcaccctgcgcctggtggccgaacacgcggacatctggcacgccttccacgacccggcgaccatccggcacaagctgtccgtcctgcacaagcactgcgcggacgtcggccgggatccggccgagatcgaggtgtcgacgagcgtgtccggcctggccgcccacgagggcgacccgcgggaaatggggcccgagctgcgggaactcggcgtctcgctgttcatcgtcggcgccggcggccccgatttcgacctcggcacgctccgccggtggatcgactggcgcgacgggacgaacgcgtgagcacgatcgacatgctccaccggcggatccggctgcactggcggctggtccggcgcgaggcggtcttcaccaggcagcagaccgcctagccacggccgcggccgcagcgcggacacggacacggacacagacacagacacagacgcaccgaagaagaggggcgctcccgaccgggagcgcccctctcgtgtgtgccgtcgtccgtgccgtcgtcccggtccgcgctatgcggaggcgaggacctcccggatgacgtgccgggcgttggccgagatgaccgggttggtgctccggtagtacggcagctggatgaccgccatggacagcgcccagccccggctgcgggcccaggtcgcgtcgtccacgtccacggcatcgcggtacgcccgccgcgccggggcgggcagcaggttccaggccgggatgagatcggtggccggttcgcccatgccgacggtgccgaagtcgatgaccgcgccgatgcggtcgccggcgagcagcaggttgctcggcatcaggtcggagtgcgtccagcaggccgggcccgtccaccggggcgcggcgagtgcctcgtcccaggccgcggtgatctcgtcggcgtcgaagggctcgtcggtgcggcgcagcgcctcgatcgccgcccgcatctcccggtcctcggcgatcagcggctcgccgcggtgcgcgggcggacctccggggaggtcgatcccccggatggcgaccgcgaagccggcgaggtcgcgggccacgcgctcggggtcggcgaggtcgccctcgacgggggtgcggccctcgatccaccggtgcaccgcccaggccagggggtactcctcgccggggacgccggtcgccaccacctcggggatcggcaggggcagcagcggcgccagcctcgggagcagccctgcctccatggcgatggcctcggctccgccgggacgcagcgggagccggacggtcaggtcctcgccgagccggtagatcgcgttgaccgttcctccggaggcgagcggggtgaccggaaggtccgcccactgggggaactgagcgcgcagcagccgccggaccaggccggcgtcggtctccgtctggtccgcgtgcatcttgcccatgtgtctgtcagccctctcgatcgctgcccggatcgtcgcatattcggatcgcgacccggggtgggaaaacggcaggtgaaaaagcggccggccccggagggccggccgcgggtccggtcatggaccgggtgggcggaggtggagcagggccgcccacggcagccacgcgttcttctcgcggctcagccggtccagggcgcgttcccgtaatcggcgggcttgcgcgtggtcgccctggcgggcgtgcagcgtgctcgccacccacagggcctcgacgtgcaggggcccgggctccgccgcggtgatctcgcacagttcgcgggcgtgggcccgggcctcgtccgggcggcccgactcggcctccgcgcggatcagcgcatgcagggcgtcggaccggtcgtccaccgacaggccctcggccaggcggtgtgcctcctgtgcctcggcgcgggcgctgtcggcgttccccagccgcagggagcaccgggacagccgggtgcgggctcgtacggtcagctcggggatgccgatcgactcgctgagctcgccgagctcgacgaggagctcgtgtgcgtcctcgtaccgggcctcctcgtcccgtaccgaggccagcagccacagcgactgccagcgcaggccgggatcgagccggtcctcgcccgcgtgcagcagcacggcgagatcgtcggcgaccgtgccgatgcgcgccgaggacacggccagggccagggccagggccaggctccggctcgacttcctggcgaaggccgacggcggcaggcccagctgcctggtgagatgttcgaggacccgtcgggtgggcggccgggtgcccgactcaagccgggacaggtagccggtggaaaggccgccggcggccagcgcggcctgcgacagtcctcgctccttgcgcaaggccctcagccgcagcccgaaggcgggttgttccagcactgcgacctccggtgacgggcgcgggcccgtcagtagcgggtggtgtaggtcaggaaggcgaggtcgtcccccatctccttgaccgcccggatgtcggcttccttgatcgcgggatacacctgccggcgcagcggacccaggacgtccatcaggtagtcgtcccggcgcagtgcctccagcgactcctccagggaccggggcaggcccagcccgaggcggtcgcgttccgcgtcggacagcccgttggggtcctccgcgagctggggtcccggatcgatgcggtggttgatgccgtccatgcccgcgtagatcaccgcgcccatggccaggtacggattggcggtggagtcgaccgccttgagctcgacgttggtggacgcggccgcggcgccgcgcagcctgctcgggatccgtacggcggcttcccggttgtcctggccgtagccggcgtgcgcgccggaccacatgcccggccgcagccgctcgtagctgttgacgctgggacaggtcagggccagcaggccgggcaggtgccggagcaccccgccgatgaagtggtaggccgtctcggacaggcccagtgcgtccgcgccgtcggcgaacacgttctccttgccccggcccgtgcggtcctgccacatggacaggtgcaggtgattgccgttgccccggaagccgggggcgggggtgggggcgaaggtcgcccacaggcccatggaggaggccatcccccgggtgatcaccttctgccacaccgagaggtcggccgcccgcagggccggtccgtgccgcagggtcatctcgtgctgtccggcgccgaattcggggtggtacacctccacgtcgatgccctgcccctgcaggccccgaagcagctggatcacgtagtcgttggcggcgtcgaagccggtgttgtcgaagcacaggctgtcgtcgagcacgtgcagcgcgccggcctccggccgggtgccgcagagcgtgaactccggttcgaaggaggccacgacctcccgttcgcccgccgccgcgagcgcggacttcaggaaggtacgggggcaggcgtcccagggctcgtcgtccagctggaccaggtcgcacagcatggcgccggagcccggcgcgtgcgggagcgcgacgaaggtctcggggtcggggaccaggcgcacctcgccgacggcgtcgaagccgggcaccggcacaccgatgtccatgaggccggccgcctgccgggacttggccagcccgatgcccgatgccatccgggattccaggtaccggcgggtcaccgccttgccccggacgatgccgttgtggtcgacccacaggaagcggatcagctcgacgccgtgcgcgtcgatcttctggagtacctgccggtacgcgtcgccggtcccggacatctcacgcctccttcgggaacgggaagtacgagacggtcccggccggcagcggttcccactgcccggccggggcgagtcccgggaccacctcggaggcgatgacctccaggccgggcaggctcaggcgctgcatcgcgaagaacaccggggtggccaccccgggcgcgctccagtgcacgaggtaggcggccccgggatgcacggcgatggcgttgccggagttcccgccgggcggcagcgcgtccagcttggcgagtgcctgcgccgcgtcgaggccgtcggcgccgtgcgggacgaggtagtcgaagtactcgcgcgagtcgaactcggaggcgggcaggcccagcccctggtacgcggtcggcaggtagccgttgtgcatgaagtaccagccgtcgtcccgcgtcagcgggtgggtgaagccgaggccgcgctgggactccaggctcgcgttgcgcgtgtggacggccaggaagtcggtcttggtgtccggcagcggggacgcgtgcaggctgtcggcgaacggccggacgtcggtgtgcgcacgcagcccctgcccgggctcgcgccagaccgcgccccacccgtgcgcgtgcaccttggtggggttgtcgtgatcggcggtccggccacagctcatgtccagggcggcggcggtgatgtccgctacggcgaaatccccggaggcgaggatgagtcggcacatggtgggtccttgtctctcccggctcaggcggccggttctcgggtgagggtgacggccgtgtcgcgccgggggacgcggcgggcgagcacgtggaggagggcgcccgtgcccagcgccacgcccagccagtagccgtgggcgaggcccgcccggtccagggcgaggaacacggtgccgccggccagcgagccgagcgcctcacctgcggtccagctgacctggcgcaggttgaaggcttccagcgtggacctgatcggcagaccggcgaacgcggtgctcaccatgggggtgaacagcatttcggcggtggagaacagcgcgacggccagcgcggcgccgagcacgacgggcagtcccacgcccagcaccaccatcgaggcgctgaacagcacggcgccgtacaccagcagcgtgaacggccgggtgcctttggccagcagcctgcccgtggcgccggtgacggccgtctggaagacgacgatggccagggcgggcgcggcgagcagcgcggcccgcaccagtgcggagtcgacgtcgcgggcgacgaagagggcgaacgcggagtacagctggccgtagacgaaggcgccgaggacgcagatcgccaccgtccggcggatcgaggagtcgtcccggaccagccgcagcacggcccggctgacgggccaccggctggacgtcgcggtgggccggagctccctcgggatgccgaaccgcagcgacagcccggcgagcagatagcacccggcgacggtggtgagcagcacccgggggtcggccgacgagtacagcagcccggcgaggaacgggccgagcgccgcggccaggttcaccgcgatctgcaggaccgagtacacccggtggcgcccgacggcgtcggggaccgcctcggcgaccaggaccctggacagcaggaagtggacgctgccgccgaagccggccaggacgatcagcaggatctggaccgcggcgtcgtggctgtagggcatcaggccgaagcccagcgcggacagcaccgtactgccggtcatggcgccgacgatgctgaaccggggcagccagcggttcaccagcagcgcgcagaccccggcggacgcgctgtagaggaacagcccgacgccgacgatccactcgccgccgacctgggcggtcaggaagacgcccagtacggggaggatcatgtactggccgaggttgccggccacgtggtcggcggacagccaggcggtgaaggccctgcggttcatgccccggcctcttccgtctcggcttccgtctcgaagcggaccgccgcggccagccgttcggcgagttccgccgcctggcggggggtgtcggcgccgaccacgaggtatccggcccggtcgtaggactcgcggatctccccgacgacgtctcccggccgtacggtcaggtccgccttcagtacggccgggtgccgcagtacctcgtcccagccggcgacccggctcacccggcccgggggcggcgcgaggaagcggacggccgccgccctggagggcgtcagctcgtacgcgccggtgtccgagccgagcgcgtcgtcgatcaccaggccgaacaggtcgagcccgggtatggcgtgttcgagcatcaggtggatccagtcgccgccgttgcgtacgtggacctcgccgagcaccggaccgtccgcggtggaccacagctcgacgtggaagacgccgaaccgcagctccagtgccttcagggcaccggtcacggcctgctcgaactcctggcggagcccggtgggcaggtcggcgggcagcacatgcccggcctccacgaaattcggcggcggcagcagcttcttctcggtcaccgccagtacccggggctcaccgcgcaggaacacgccttcgacgctgtactcggggccctcgacgaactgctcgacgatgaactccgtacgggcgggcagcgcggcgacggcgtccgccagctccccgggcgcggtgaccttgcggacgccgaggctgccggaggcgtcccgcggcttcacgatccacggcccggccgtgccctccaggaaggcccgggcctcggcgagatccgcgcacagccggaactccggctgcggcaggccggctttgcgcagcgcctgacggcagcggtccttgtcgcggacggtacgcacggcctccggcgggttgccgggtgcgcccacggcccgggcgacctcggcgagggcgacctgtacctgctccctgacgccgaggaccacgtcgaactgccgtccccgggcccaggccgcggccgccgccgggtcctcgacctcggtacggtgcagggcgccggcgagtgcggccagttcgggcacgtccgggaactcgacggtgacctgcgtgccgaccttgcgggcggcggcctgccggagcagccgggtgcccacgtcgcggccgaggtccatcggcgcggacccgccccagaacagcagagacctgggtgtgtcgttcatggttctccctgggagcttgcgggtcaggcggccgggtcggccagccggaagacgtcctcggtcagctgcccgatgacctggtagtcggcgaggatctcggcgtgcgagccaccggtgtggaacacgcgcatgggactggtcatcaggtcgacggtgggcaccagccgggtcccggccgggcgccggaccaccacttcccggaccgtgggcagcgaggcgatcttgtcgaccacggcctggtcgatcccggccacgaggccctcgcgggcggtggcggcgttgtggacgaccgcctcacagctcttggcgtagacccggccgccgtagcgggcggtgaactcggcgggccgcgcgtaggcgagggcgcccaggcgcgccgggttggtcccgctgaacgcgtcgtggtgggcggggttcatgttcccgttcagccgggcgcccagctccaccagggccgggcccgattccgtcatgatcacttcggcgtggccggggccgtgctcgatgcccagggcctccaggacccgcagtacgtaggcgatcagttcgcgcacgtgcggtgcgtccgggtcctgcagcacgtccaggtcgtagacgggcctgccggagggcagcaggttcttgtcgtagcgccacactccgcacaccgtgtgctgcccggccgcgctgaccgtgtccacgatgtactccgtgccgtccaggtaggactggacgaggacgtcggtgttgcgctggtcgtacatggtgatgccgtccaggaccgctcgggcggcctgcgccacctccgcctccgacccgcagatgaacacgttgtccgaggaggacgagctgcgcggcttgaccaccaccgggtagcttccgtgctcgcgggcccagcgggtgatctcggccgggtcggagccgacgtactgtccggcgcagtgcaggccggccgcccgcacggtctcgatcatggtgaacttgtcgcgccgggccgcggacttcgcggtgccgttggtcgccaccccgagccgttcgctcagcaggtccgccagcgggaccccgggctcctgaccggcgaccaccgcgatcggggcgtaggcgcgcagccgttccacggtggcgtcgaccgcgtcggcgccggcgcacacgaaggtctcccggtacacggacaggtccggcgggaccatcttgggcaggaactccgccgtgctctgcacgtgcagcgcgtcgattccgagccgggcgtactccgctgcgtaggcaccggagttggagtagccgtcgacgatgacgaccaccggtgcggcggatgtggcgttcatgggttcctctcctcagccgagttcggcgcggtggtcccgcagcttgccgagcgcggccacgatgtcgtccacatcggaccgctccccgagcagcgcgctgtggtggaaggtcaggtgacgggcggcgacccgctcgctgacgggcagccggtgccgggcccggtcgatccgcccgcggtgtgcggcaccgaggtcgaacctgcggcggctgtccggccggtacagcgggctggccgggatcgccgggtagaccggcttgaccggcaggcccagctccgcgctcagcgcggcgccggccgcggcgctgtcgatgccgtcgaactcctcgggcagccggatcacgaacccgaagtaggtccgccgctctgttccgtcggaggtccgctgggtggcgaagccgaggtcggccagcgccttctccagtacggcggcctgcagcgcccgctgttcgttctgccggtccagccggccgagctgggcgatgagcaccgccgcgtggaactccgacagcgcacggttgctgcccatcagggtgccggtggtgaccagttccatctcgtgcagcggcggtggccggtcgggctggtggcggccgtcggcgcgcagttcggccatccgccgggccagctccgggtcggcggtgacggccgcgccgccttctccgcaggtcagcaccttggtgtggtgcatgctgaacgctccggcgcggcccatggtgccggccgcggctccccggtagaccgcgccgtgcgcctgtgcggcgtcctcgatgagggtgaggtcgtggcgccgggccaggtcgcgcagcgcgtccatgtcggcgagtgccgagtacaggtggacgacgacgatcgccttggtggcgggggtgatggccgcttccgcggccgccgggtccatgcacagggtgtccgggtcgacgtcgacgaagaccgggaccgcgttcacggcgagcacggtcgacgcggtcgcgacccaggagatccccggcacgatgacctcgtcacccgcgccgaccccgcacgcctccagggagatcatcagcgcggccgtgccgctggccgtcggcacgcagtgcgcgacctcgttgtactgcgcgaacatccgggcgaaggtccgctccttggtgtccgtgccccggtagggtccgctgatcgaccagcgtgcggagtgcagcacttcggtgagctgctgcacggcctctgaggcgggctgcggccacagcggccagccggcggtgcgcaccgggtctccgccgtgcagggcgagcgtcatgacacggcctttctcgtccgtcgggaagggtggggcggaaggggtggggcggggcggggccgggtgtcagagcaggccgcggatggtgccgccgtcgacgccccagacacttccggtgacgaaggcggctgcgtccgaggccatgaaggtgatcacctgggcgatctcgtccggctcgcccatccgccccaggggcagctgacgccggccgagctcgtgcctgaccgccgcctcggcgtcccggccgtgcaggtcgcccagggtgtcggcgaagccgccgggccgggtccacaagggggtccacacggggccgggggcgaccgcgttgacgcggatgccggggccctcggagagtgcgaggctcttggtcaggctgaccaggcccaccttggacatctggtagtcgaccagcccgggttcgggctggcgcgccaggtcggaggtgttggtcaccacgctgccgtggccctgcgcgcgcatccccggcaggaccaggcggatcgcccgtaccgcgctgaggaagttgatctcgaaggtcgccaggtagtcggcgtcggtcaggtcgtcgaaggaccgggccaggcactgcccgacgttgttgaccagtacgtcggtcgtgccgttccagccgtcgaggatgccggtgaccccgctgtgcacgccgtcggcggtggagaggtcggcggtccgcacgcggacctccccgcccttgtcgcggatcgcgtccgcgaccgcggacaggccctcggcgtcccggtccaccagaccgagcctggcgccctcggccgcgaaggccatggccgtggccgcgccgatcccgctggccgcgccggtgatgagcacgcgccggccgtcgagtcccaggttcatcggaccgccacccgggtgctgatcagcgagaccggtcccgccgcgcgcaccgtccagggagtgtggggcgggatcgcgagcgacagcccgggcccgccttcgtgccgctccccgtacacctcgaactcggcgttgccgtccagcagatggagcacctgggcgtggcctgcctgcgcctcctcggtgacggtgtcgccgcccggcacgtccagcagggtgaaggagtcccagtcaccggtgaagtacgggcgcaggtcgacggtcgcgcgccgcacgccgtcggtgtccggcagccgggccggtacgttcaggtgggccggtgcggccgcccgtccctcgcccgggtacacctcgatgacgaagaagtgcatctcctcgtcggagcggttggcgatggagtgggccgccccgatcggcgtcgtgatcaggtcgccggggccggcgtgcagttcgacgtcgttcatggtgaccacggcctggccgcggacgatgtagtagatctcctcggtgcgcatgtgcacgtgctcaccgacggaggcgccgggggtgaggaccacgtactcaacgcagttccactcgccttccaggtgcatgccgttcatcagcatcttccaccggcacgcgccctcgccgccgacctggcggtgggtgagggccggaccgctggtgtcgttgatgatcgggccgaacggggaccgctcgccgcggacgatggtcgccatcacgccacctcggcggtgatggactcgatgccgaggcggacgacggcctcgggcacctgggtgatctgggcgccgcccgggcggtgcggcttgccgagcccctccaggaggatgaggtcgcgggtgccggcggtccccttgacgtagccgcgcttgttgtcgagcgagatggtgcgcagcaccccctccagggtgaccccggcgggcagtacggtgggggcgccgttgaggacgagcagctcgcggtgcgcggcctcctcctcggcggtcagcaggcccagttcgcgtgcgatccgggcggccgcgagcatgcccaggccgatggcgtagccgtggcgcagctcgccgccggtgagcagctcggccgcgtggccgatggtgtggccgtactccaggacgagggcgtcgccgcgctcgtgcaggtcgtcgcgcatcacggcggacttggcgtccacgcacaggtcgatgaaccaggcgatgtcctccggggtgtactgcgcgtcggcgcgcagccgggcggccacgtccgcgtaccggtccggcacgatgcccagcacgttcttgatcatttcgcagagcgccgagcgggtctcgtccgcgggcagcgtgcgcaggaagtccaggtggttccacacgaagaccggggcgtggaaggtgcccaggtggttcttgccgacgctggagttgaccgcctgcttcagtgagagcaccgagtcggacatggccagcagcgtggtcgggatgtgcacgaggcgcagaccccggaacaccagggcgctgagcaggccggccatgttgccgaccaggccgccgcccagggcgatgatgacggagcgccgcgtgacgccggtcgggatcagccgctcggcgagggagttgaccacgtcgaggctcttggccttctcgtcggccaggacgggcagcaccgtggtgggcgcgacctcgccggcgcaccgggcgatctcgtcgatctgctcctcggacaggccggcgtcggcgacgatcacgaatcggtcggcgtcgaggcctcccagtttgcgcgtcagggcgctcagcgacgtcggaccgtgtccgacggagaacccgtagcgcacgccgccgaaacggatctcgcgctcgctcacggtcataacttcggccaacagagacacaacttccccattcactggttcgaacttgcgctgggcggctgagcaactcgctcgggtgcggccgcggccagtcgtcgccggatggcacgccatctcccggctggtggcgccgaccgtagcaacgtcaggcaacgtttggcaacgtcgtgccagcggccgactcccccaccggcccggaccatgccgcagggagagcctgttcggccccggccacgcgcgcgtgattccatccatgcaggcaaaagggcttgtcaccgagaggcatcaaccacttgccaacatttggcaaccatggcaatgttccggtccgggacggcgatcacaccgcctgatgagccataccggcaggaggtttttagggtgactgagcaatggggtcgcatcgtcatcgacgtcgatcgcgacacggacatcgacggagcggacctggtcaggcgcttggccgacggcacggtggccgtcgtggtgctgcgcaatctgctgcccgagtccgagttcgacgcgaaccgggagcggctcgcgccggtcttcggccaggcgtcgaccacgcagtacagcaacggcagcctcaccaccatcggcccgtacctggccaagcacctgcacgagccggacacctacttcgccgaggcgcagaaggccaacgagttcaccgagtccatcggcgtcgacctcggcgcgcggacccgtcagcggctggccgaagtactgggcctgaagcggttcgacaccgaggtcgaggccgacggccgcagctactcgcagcagaacgtacggatctacgcggacaacatccgcaccccgctgcacaacgacaacatcatgcgcgacgccgcgggcaccgggctggccctggccgacctgcgccaccagctcagctgcgtggtgtgcatccaggagtgcgaggacggcggcgagctgcggatccaccgcaagcggtggtccgaggaggacaaccagtacaagatcgtcggcggtctcggctacgacgaggcggtgacgggcgacgcccccgcgcacgagttcaagccgcgggccggcgacgtctacctgctcaaccccacgtactaccactccatcgagcaggtctccggctccgaccggatcaccatgggcttcttcttcggcttctacgacgacgagctcgccgaagccgtcgcgtggatctgacggccgggggacgggacatgagcgagaacatcctggtcatcggatccggggaccagcacttccgcgactacgcactgcgcggtctggccgagcgccaccgcgtcctgctgatcgcccagaccccgctggcctggcaggcgccgtacgtggccgaccaccgcgaggtcgagctgaaggaccgcgcgcaggtactggccgcggccagggaactcgccgcgctgcacgacgtggccggcgtgctcacctgggacgagatgcaggtccgcgtggccgcggaggtcggcgccgaactcggcgtggcgaccatgccggtcgaggcggcgcgcgcctgccgcgacaaggcccgccagcgcgagcgcttccgggcgaccggtgtcgcgtcggcccgttacgagctcgccggctccgaggccgaggcggcggccgcggccgagaccatcggctaccccgtggtcctcaagccccggggccaggccgcgagcatcgccgtgcggatcgtccgctccgaggccgagctgcgggagacgttcgcgctcgtccgcgacgcggagaacccctccatcgaggacggactggtcctcgtggaggagttcctggccggcccggagatcgcggtggacagctgggtgctcgacggcaaggtcgtgcccttctcgatctcggcgaagcgcaccggctacccgccgtacttcgaggaagtggcgcacgtcgtcggcaaggtcctggacgcccggaccgaggccgcggtccgcgaggtggtgatcgccgcgaacgaggccctcggcatcgaccgcgccgtcacccacaccgagctgatgctcaccgcagacggccccaaggtcgtcgaggtcaacggccggctcggcggcgacctcatcccccacctcgcggagatcgcggccccgggcctgtcgatcggcggcgtcctcggcgccgtcgccaccggccgcgaacccgggccgatgccggagccggaccgcctggtcggcatccgcttcctctaccccgccgcggacctcacgttcgacgacatcgaggtcccggccgggctcgccgacgagccgtgggtgcacgaggtacggcgggtcagcgaaccgggcaccgaacttcgcctgccgccgaggcagttcctcggccgcgcgggcttcgtgatcgcgaccggagacagcgtctccgacgtggacgaacgactgctggcgctcgcggacaaggtgacgctcgccggcaccccgctgggcgaccagaaccgatgacaacgcacgacgattcctctgacaggggcaggcacatggcgaaggcggtcattttcggcgagtacaaactcgcccggatccttccggggctgcgcgcacgcggcatcacggatgtagtggtgtactccgcggtggacttcgacggcttcgacgtcgaggtcaagcgcatcggcctcgactgggacgccgcggacgtcctggaggtcctggccgaggagcgggcggacgtggcgatcgccaatccgtacgcccacggacaggaacagctccccctcgcctacggcgaggctgtcggcaagtgggacggacacttcctggcgcacccggccgcgttcgccgaggtcgcctgcgacaaggtgaccctgcacgagacggcggtcgcgcgcggctggccggtgcccgagggcgccgtgtgcaccgacgccggtgaggtccgcgcggccgtggaccggctgggcttccccgtcgtcctcaaggaggcccagtcccaggcgggcgacggccggttcttcgtgcagtcggccgccgacctggacgcggtgctggccggcgagccgggcctgccgatgatcgtgcagcgcttccagcagggcttcgagtgcggggtcgaggtgatcagctccggcggcacgcacgtccgctggcccgtcgcctccctgggcagcctggacaccggactggacccctccttccgggcgcgggccatgcccttcgcgctgcccgagcgcgccgccgcctccctggaccggctgatcctcgacatcgagcagaacctcgttccgtacggaccctggcagatcgacttcgcggtcgtcgacggcgacctgtgcctgctggagatcaacgcccggctgggcggcctgtccgacctggactccgtcgccaccggcaccgacccgcactcggtcttcgtcgcggtcgccacgggcgaggacctccccgaggtcacccagcgcctggtcgcgatcgagctgccgtccaccgaggttcccgggaacccgctgccggcggagcccgagggcagcaacctcatgacggtcacggcccgtacgcccaccaaccggtgcttcatcgactccgaccacatgcaggtcatcgtcaccgtcgccgagcccgcggccaccaagaagtggatcaccgagctgcacggcgccggcctgctgcggtgctcgacggacagcgccttcgcccagctggacaaggcactggccaccttcggggagacccggcgatgagggtactgatcgcgggactgggcgagaagaaggagttcgggctgcgctcgctgcgcgacgccggacacttcgtcggtgtcatcgacctcgcccaccgcatccccgtcagcctggtggactggtggcgggccggcgaccggttctccgtcgaggcgatgctggccgccgcccgctccgccgacttcgagtgggacgccgtcctgtgctgggaggagctgtccaccgacctcgcccgcgaggtcgccgcgcagctcggcgtaccggccacccgcatgccggccggccacttccgggacaagggcgtcatgcacggccgcctgcgggaactcgggcttccgaccccgcagctgggggtcgcccgggacctggccgaatgtgagcggctgatcggcggccggtacccggccgtcgtcaagcccaccgactacggcggcagcggcggcgtcaagatcgtgcgcggcccggacgacctgccggaggccttcgccttcgcactggacgcggcgcgcaccggccgggtggcggtcgaccgctacgtgtccggcaccgagtacagcgtcgaagcggtcacctgggcccccggaaagaccgagatcgtctcggtcaccgagaagcacctgagcaggccgccgtacttcgcggaggtcggccacgtgtccccggccgtactgccggacgaggtccgcgagcagctggagtacgagaccgtccgtgtggtcgaaggcctcgggatggaagcgggcgtgtcccacgccgagttccggctgacgccggacggtccggtgctgatggaggtcgcgggacggcccgcgggggaccagattccccgcctggtggccctggccaccggatggaacctctacctcgcggagctcggggcggtcgtcggcagcccggtgtccccggaggcgccctcagtggaacgggccgccatcaggttcttcaacggtgacggcgtgacgccgttccggcacccggtgaccctggacgacgcgatcgcggcgccgttcgccgaagtgctgcacgaactctgctacttcgagccggagggcgcggtcaccgacgccccgcgcggcatcggaggacgcaacgggcacgcggtactggccggctcgcgcgagcaggtcgccgaagccctgcacctcttggacaacggcgccccggtctaccagggcgacgactagccgatcctacggccggctccgcccgcgacgcggagccggccggggcgagcagggagaagaagtacgtgctgacgatggaaaccgcgccgaagaccgggcccgcgccccaccggggcctgtggcgcaactacgacttcctgaagctctggtccggcgagaccgtcgcccagatcggggcgcaggtcacccaactcgccctgcccctgctggtcctcggggtcatggacgccagcgcctcggaggtcggcctggtgtccggcatgcagctgctgcccgccctgtgcgtgacgccgctggccggtctgctgatcgacacgtgggaccgccgccggatcctcctgggcgccaatctcgggcgggccctcgccctggccgtggtgccggtgctgtacttcgccgacgccctgtcgataccggcgctgtgcgccatcgccttcgtggtgggcgcctgcaccgcggtgttcgaggtcgcctacatcgcgtacctgccggtcatcgtgcggcaggacgacctggtcgaggccaacagcaaactgcaggcctcgtactcggtgtcgcagatcggcggccccggcctgggcggcctgctgaccaaatccctcggcgcctggttcgccatcctcgccaacgtcgcctcgtacctggccgccttcgtggtcctgtacctcatccgccaccgcgagccggcccgcaccggggacgcggcggcgaaccggccccggttcgccgacatcttcaccagcttcggcatgctctggcgccaacgggtgctgcgggtcctcaccttccaggcgggctggttcaacttctgcgagcaggccgtcatgaccctgttcctggtgtacgccgtcaaggaactgcacatggacgccggcggggtcggcaccgtcctggccctgggggccctcggctccctgctcggcgcgatggccgcaaaaccgctcggagagcgcctcggcttctcgtccaccctggtcgtgtcgatgggcgcggcgtccggtgcccccctgctgctcgcactgaccggcgggtccgagtggtccagcttcctgctcgccgtcctggccttcgggatctacggcttcggcctgacgatctacaacgtccacgtcgtcgccttccggcagtcggtcatcccgctcgacgtgatcggccgcgcgacggccgcctaccggatgctcacctacggccccttccccctcggcgcgctgctcagcggcgtcctcggcgaacggatcggcctctggaacgcgatcttgaccatggcggtgatctccgtcatcggatggctggccttcgcgctcgtcggacggaagtccctgcgctcggccgaacgcaccgcgcaaacgagctgacgagccgacgagccgacgaactgacgcgctgacaagacatttctgacatcaccaaccaactgggaggcttcacatgaccgtcaacaccgaccgctacccgctgtgggaatcgctcgtccagcccagccgctacggacggcccgaggtccacgggatcgcctgcgagggcaaccgggtccacttcgccgacggcacctccgccctcgacgtgatgagcggcctgtggaacgccaacctcggctacggcaacaaggccgtcaccgaggccatcaccgactgcctgaacaccgcgtcctacctgcccctcttccgcggcgggcaccgcctcgccgagcaggccgcccgggcggtgctggacgtcagcggccccgaccacttcggccgcgtcctcttctccacctccggcggcgccgccaacgacgtgatgatgaagctggtccgccactaccaggcactgcgcggcgaagagaaccgcgacgtggtcgtcggcctcaagaacagctggcacggcctgacctacggcagcttcgccctgacgggccagccgctggggcaggacgtctaccgcgtcgaccgcagcaaggtccggcacgtcagccacgaggacgtcaccgagctggtcgagctgctggacagggaaggcgacaagatcgccgccgtcatcctggaacccgtcctcggcaccggcgcccacccggtctccgacgagctcctcggcgccatcgaggacctccgtgcgcgctacgggttcctcgtgatcgccgacgaggtcgccaccggcttcggccgcaccggcagctacttcgcctcccagaactggcccttcaagcccgacgtgatgatcacgtccaagggcctcaccaacggcacgtgcgccgcctccgccatcgtcgtctcccacgacgtctgcgagatgttcgagcgcaccgacgccgtcctcttccacggcgagacccaggccggctcgcccaccagctgcgccgccatcatcgccaccatcgcggagatggagcgcctcgacgcggtcgccctggcgcagaagctcacccagaagctcgacgccctgctggaggagatctcctcccacccgctggtcgtggagacccgcggcctcggctgcttccgcggcatccagctgtcggtcccctccgacgcgctcaccgcggcggcccgccgccacggcctgatcgtccagccgggtaccgacttcatcatgctggtcccgtcgctgacctactccgacgaggagttcgaggagctcgcgaacgggctgcgcgcggccctcgacgagatctgagggcccgccggcgagtccatggccggccacgctcaacgtccgaaggctccccgccgataccggtggggagcctcgggcgttgtgcgtcgcggaccgcgtacccgccgggcgcggcgccccggcgactcggcgactggacgactcggcgactcggcgacgaccgggggtcagccggcggcgctgtgctccagggtctcggccaggacctgccagatctcggcggccaggtcgaggttggccgcgcgtcgggcgtcctcgcccaactgcttgagctgggcgagcccttccttgcggcggccctccacgatcagcagcctgctgtccagggtctggagccttatccggtcgcggtagttgagcatcagctcgtcgacgtcgagccgggagtgagccgcgcgggcgtcggcgtaccggccctcctcgaacgcgaggtgggccttcagcaccaggatctcctgctgctggagcggcgtaccgacgagggcgaacgcctcctccgcctccttcaggtagacacccgcggactcggtggacggcggcgcgccctgcaggtgcagggaggccgcggccagccgcagccgggcccacagcacgggagcgacgcgactgtccaggatggccatggcttgctgcaggaacgcgcgcgcggcgtcgtcgtccccctggcgcgaactgaccgtggcggccgtccagagcgcttcggcgcgcagggtctccggcgcctcggtcaccagcccgaccagctcttcggcgtgcgcccgtgcgtcgggcagccggcccgcctccgcctcgacggagaccagggcgagcagcgcgttcgcctcgtcggacaccggcaggccggcctgcttggcgacctggtgggcgctgacggcgagctccagcgcgcgggcgacgtcccccgtggaacgcaggcagcgggcgaggcggctcttcgacctgcactgcagtgcgggcagttcgagctcgtcggcgatgccggtcagctcttcgaggcaggccagctcctgggcctgctcgccccgcgcgtgccagtaccgctcgatcagccacagcgcctgccagcgcagcagcgggtcctcgtcacgggaggtggcgacgacgtcgatgaggtcctcggttgcctcactgctgtccgaggacgtggcaagactcagtgcctgggagagcgaactgctgctcggctggatgtaaaaggccgagcggtccacatccagccgcttggcaagatagacgatcacccgctccgtgggagtccgggcgcccgactccaggcgcgacaggtatcccgtcgagatttcatcgcccgccagtgcggcttgggagagcccttgctgttgtctcaacgccttgaggcggagcccgaaggacggctctgttgccatgtggaccctacattcaattcttcggatgcggccagccccctccgcgtcactttagtcagccgtgggcggtttggcaaacctgctgcctgacgctctgccacgaccttgcgagaggtgcagatttttggttgaccgcgttggcaatatttggcaagctcggctgccggaaggggtcacggggcccggttcgacgctgttgcggagcgtcgaccccctgcctcatctggacctttcccccttgcctgtcttgtcctcggtctgtttggagctgtcatgcgcatgcgtacccttgccgcttccgtggcgatcttgatttccaccttggccttcgccgccacggtcagggcggacatcgactggccggtcccgaccccctcggtcgcccccgcgctcgccgccgggaccacgtccgacgtgatcgactggccctgaccccgccatgagacgcgcgagccgcagcagcgcggccttaccgagtacggcccgccacccgtgaaggaggcgggccgtacgcatgtgagcgccatgccgcccgggcgggctcaggccggctgcacggcgtcagggccgtgccagggcctgggattcgggcgacgacgccaccaccagccgaccggcgtccgctccgcggagccaccggtcagctctctgcgcaggctccccgacgggtcttcctccgtcgcagcggcgaaccgtccgtccaactgctcaagggcctcgtcgagtagctcggcgacgtcacggggcaggcgcgccccgataccggcgagctcgtcccggcattccagccgctcccggtaaaggcaggccggataccatccggacggcgcccacccggactccatttgcgtgatgcccctctcccacgccaccaggttgcccttcgcggtccggacggggccggcggtgccgtcgtcgagggaaggcctcgcgaggcccggggcggcctgccgcaccttctccaccgataccgcgaaggcccgggccaccggcgtgtccggccgctgttcccgtacgatctcggcgaatcgcgtcacggtcgcccggggcagttgcggcaccggcgcctcgacggcggtgacctcgtaccgggaaggctcgccgtcggacggttcgagccgggcacgagtgagaagaccctccggcgtcaccgcccagtaggcactgggcggtgcttcctcggcgggaaacaggacggtcgtcaccgcggccttcgcgaaccccgcggcaaggtcggactcgggcggctggccggcgacatgctcctgcgcatggatgtccagcgaccaggccacatcaccgcggactgcccggtactcgcacgagacgggcgcatcccagttccggaggtcggggtcgccctcggaatcggccacctccacgtcacccaccgcgatacccaggcatccggcaagggcgcgggccatggcctcggggctgacggcgtcgacggtaaggaggttgtacgtcacggacacgtcccgtcgtagagcctgtcggcagctgccgctacgtcctccatggtgtcggcgaacgtgcgccagacgcgcgcgagggtgcgcagtccgtcaacatcggccgcgggccgctcggttccgggcgaagaagcgcggcagggtctcaccagggaatcggcccgtcctcggcgaagaaggcgccggtcgggccgtcgtcgcccgcagtcgccaggtcgaccgccacggtcgcgccctcctccgccgtgcgcatcccgctgtggcggttgaggtcggtcgcgcagtagccgggactcacggcgttgaccaggatcccttcgtcgcgcagttcattggcgtagagcacggtgaccgcgttcagcgcgctcttcgacgtgcagtaagggaggaggatcgagtagtaggcggaccacgggctgcccgggtcggagaagtgggtgagggagccgagttcgctggacatgttgacgatgcgtgcggcggcggagcggcgcagcagggggagcatggcgtgggtcaccgcgatgacgccgaacacgttggtctcgtagacctcccggacggctgcggccggggtctcactcggcttctgcggtccggcggcgatcgcggcgttgttgacgaggatgtcgaggcggccgaacgtggcgtcgatgtgctgggcggcggcctggaccgaggtctcgtcggtgacgtcgaggggaacgaaccgtacgtcggcgccgtccgcacgaagctcctcggccgccgcctcgccgcgctcggcgttgcgggcgccgatcagcacggtgatgccgagggctgcgagcctgcgcgccgtttccttgccgatgcccttgttcgcgccggtgatcagggcggtcttctgcgaagtcgtcatggcacccagcctcccctcacccacgggcggcagggaaagaccggaagactctggatctatagtccacggatatgagtgagctggaggtgcgggagctgaggtacttcatcgcggtcgcggaggaactgaacttcagccgggccgcgcaacgcctggggatggcgcagcccccgctgtcgaaggcgatcgctcagatggagtcccggctcggggtacgcctgctggagcgcaccacccggcaggtgcggctgaccgacgccggtcgggtgctgctcgaccaggcccggatcgcggtcgacgcggtgcatgcggcggcccggcgagcacgccgggccggtcagccgacaccgcagctcgtcgtggcggtcaagccgggaggcgatgccgggctgctgcgggagatcctcgccgcctaccggggaacgggttcgcatctgccgccgcctgaagtcgtcgtcggcggcagcggagagccgatcgccatgctgcgggacggccgtgccgatgtggcgctgctgcgcagcccgttcgacggtcaagggctggattcccagacgctcgtggtcgaaccgcgactggccgtcctccccgccgcgcaccgcctggccggacgccggcgactgcggctgaccgacctccagggcgaaccgatcccgcgctggaagggggccgccccctccaccaccgcccactacacgggacgcgacggagcggaagcaggcgacggccacccgggcttggcgccggccgacgctcccgaggggccgctcgtggccagcgtcgagcaactccttgaggtggtcgcgctgggccaggcggtggcgttcctggcgctctccaccaccgagcggcaccagcgcccggacatcgcctaccggccggtcaccggcctcagccccagcgcggtcgtggtcgcctggccggagacctcgcgctccgcagccgtcgccgccttcgtccaagccgcccacgacgtcgccgcccaccaccccgaccacatgaccgtactggcccactgaccgggggcactcccccctcgccacgacgatcaccgcaggacccaccaccccggacgctcagaaaccccaggtcgcggccgtgcctccggctcgcccccgcgaccgcgccaatccatgcgaccactcccagcacgatccgctaggctgtcagcggtcggatgaccaccaggcgtgtgcccgggaaagtgtccgcgagggcatctccacccaggtgtgcgaacgtcatccgagcagcatgtttgtcgaggcaggtcgcacgatccctctggggtttcggcagcttttccgacaagcccccgccttcgtcgccttcgtggggcttgacggaaaccccaaaagcccaggtcagagacattctgcggaagctgtcgaaaacgctccgctccccttctcggaacgctcagcccatcgctgcagctcagagacctgtcgacgacatcgtcgacacccagctcaccggatgcccgagacagcgctgtcagcccgtctcgggcatcggccattcagggcaccagggacagggcacgtcgcggctccgatgcggcccgctggccgccgccgtcgaccatcgtcatggtcaggccgaagagcatcttgttcatctcgtccgacgtgaggcccagctcggcggccaccgccgccggcttcattcccgtggagcgcaggccctggaaaaccttggtgagcacctgagaggtctcccgcttcttcatgccttcgggctccgccttgcggtagccccgctggctcagctcggtgcaggcggaacggtactgccagtcggtgaggagtccgaggtcgtgcatgcggtaggtcaaggccatcgcggacacgttccagatgaccttgcccttgaggatctgatcgacgtgcgccccggccgacatgtgaccgagcacgctcgaagcgggcatgaggaacgcgctggcaaagtcgttcgcctggcgctcggcctcaggaccagcacactctcggtcgctgccgtgcatgacgaggtgcccgagttcgtgggcggcgtcgaagcggctgcgctcggcggacttcatcgtgttcaggaagacgaacggggtcctcccgcgccagacagcaaaggcgtcgacttccgcgtagtcgggcgcgagcgagaagactcggacgccgtgcgcctccaggaggtgcaccatgttgggcgccggggaactccccagcccccacctcgtgcggaccatctcggccgcggtctcggggtctggcttgccgagagagggaatgtcggcaaccggcagacggaagcgctcctcgatccagtcgtagagcagcgcggccagcgttccggccgctcgcgcggcgtcgagagtgcggcccggagtcttacttcgacacgccacgagatgccctcggcaggcagttcgtcgatctccggaccggcgaagacgtcttccgggaagccgagtacgcctgcgagccgctccacggtggtacgacggggtgcggtgcgcccggtctcgggtcgctccgcttcctctcggaaggttcagctcatcgatgcagttcaaaggcttaccggcggctccatcgagatccccttcaggtcgcactgtggtcgaccgaccaccctcgcccctaacctgtgtcaccgaccgcatctgcaccagacaaactatcggcgcgctgccgctcggccggcaccacctcgacaaagccacgggcgggggactgaagtggtgcccgggcacgctcacgcgagcagcctgtgcagatcgttcagatccagttgccccagccgaacgtggcgatgtatgcccgccgaaccgcatcccaaccgcggtcgctgccaaggtgaatcactgccagtccaagtacgaaccagaccgtgaatgcggcagcgacgatcaaggcccatcgaaggccggcgaaactggtaacgacgatcaagccgacgattgtcacccccaaacccatatgtgcggcggggagatccgtgcgcagcgcctcgcgcacagagccgcggtcttcctggacgtcccgcttgtaattagcagaagccgagtcgtcgccactctcttgctcaaggttgtgctccatgagtaacccctctggatccaacggcagtacaggtagcctatgtcgcacttcggtcaggatcgacatcgcctgtccgccgggtcccatgcaagtgggccagttgtgcgccaaagttgttcccgaacttgagggccacctcgcacatcaagccgtcgctctcagaacggcaggcgttactcaaagtcagccgagttcggaacacgcaagtaccgggcaatggtgtcgcagtcggcgtcatagcaaaggaagcggagctcgtccccttccggcgttcgatactgcaggacctgcatccctggccgccaatggcggttacgtgaaatacgtccactctctggtacttgaatcggacgccgcgatgtccgcgtaaagcacacgccacgatcactgctagtcagctttccatagacgaaccccggaaccccatttcctgatttccaagccaaacggcaagggacggcagcacccacgcctccagcagcgacccctgcccggcgaccggctcttcgggaagccgcggcccgagtcgcagttccagcagcccatccgaccaaagccaggagggcgatccatatcacaaattccacgcctatctcctcatcgaattctgcaccagcggaccactcaggttgaccaagtacgagcaggtcctctctctaactcgcagacccgcgcattaattccgacctctcggcccctaaccataagtccaccatctcagaaatgggtccagatcggcatttatgcccccaagcgaacggcgctgagcctggcttgccagtctcattggatcagcacgagtactcaaatcttcgggcatgagctcagcgcccgacggccttgaatcgcatcaccccctcacccccccccaaaaaaaagggcgtaatctgagcggctagggaatgacaaagcgcccctgcccgacgaagcgtcgagcaggggcacaagtctagcccttaacgcccgactagaagaggtttttcatgtatgtggccacccttcccttcatgccagcgaagtcggtcctggcaagacctgcaaatagcggatcagaagcccctcgggtggtgagcccggggccagcgattccttgtttggggccgagcgtcaggccgcccaaaagccctcgaccaaatgtcgccccaccgatcattcccatcgcctcagccttcgcggtaggaagaaggaactgagtggctccttgagctctctcttcttcagacgcaaccgccatatgggcacccaatccagcagtgaataccgcggctgcccctaccaaaaatagcccgccaccacacactacagacgcgatgcaagccgcagttcccgcagccgccacgatgccgattccaatatttacacccttatgcttccaccagtcggagcttcctccggttacattccatgcaccgcggaaatcaccggcctttatgtttgcaatgaaccccttcttctggggcttcttctcgacctttaccgaggagcccgaccagcgattaccggagggcttgcacccagggtcttttcggcaggcatagttgttgcggatcttccgtttcacatattctgcgtcgagcgtgccgccggcgatggcgacttctttctcgtagctgtagccgtagtcataagggttactaccattcgtgcacttgtacatggcgctctggcactccggaagggcttcgcccgtcgggtcccattcggtgagcggactgttgttgccgtactggtaggcgttgtgctggcgcgggtcgtccgcgagcatcagcgggtccacggagaggaaccgccccagaatcgggtcatattcgcgggccttcagatggataagcccggtgctcttatcttgcgtgcctccgacgaagccgcgttctccgggccatgccgccgatccctcgccacggtcctcgccgaacggcttggtcgcgcggcgctggacctgcagggtcccggcgtcgatggcggtggtgccggtgttgtggtggtcggcggcaacataggagatcttgccgtcggacgtgcggacgatggtggtgccgccgggggcggagtagtagcgggtgccggacactgtgttcgtggcggtgttgagggtgagttcgttcgagccgaggtagagagtggtcttccccgggtccttgcgcagcagcctgttgccatcggcgtcgtagaggtaggtggacgcgccggcagcagtggtggccgaagcgagtttgccctcgggcgtccaggtcagcttctgaccggtgtccgtggcgtcgggacgcgtgagcgtgttgcccgccgcgtcgtaggtggtgggcttggtgacggacgggcccgcgcccgtggtcctggtggtggaggtcggggcgtgcgggcgcggggagccgggcgccgggtaggtgtgggtggtggtgacggtcttggccgtgtcaccggcggggtcgtggtcggtggatgaggtgcggttgccggtcacgtcgtaggtgaaggactggtggtacggcgcgaggccgccgatcttgccaggttggggcgcggagttggtacagccgccgatgccggggacggatggtccgggccgggttgtggtggtgccggtgtcggtccaggcctgggtcaggcggcgcaggtagtcgtgcgtgaagcactgggtctcgcgtccggcgccctgtgtgctggtgaccgaggtgacgtcgccgaccgggttgtaggtgtagtcggtgatgtcgacaggggtccccgagtcctgcttcttgagctgggtgttcaggagacgtccggtggcggggtcacgggtctgcgtgaagctgacctgacgtgggtcgtcaccaaaggtagtgcgctgcaccgatccgaactcgtcatagtcggtgaagttgacgtagttgacgttgtccgatccgtaggaggtgggcagaccgttggcattgcggccggtgtagaggcgctcctggggcagaccgcccatggcgggcagggtggtacggcgctccagccccgtgatggggtcgtaggtggtggcagaggtgtaagtgccggtgagttcgccttccccagcagggaccgtcagtttggcgcctgtgggccggtagccgatgtcataggcggtggtctcctgccgccagggcttgccgtccacccaactggtggaggccgtgggctggccggctagcagggtgtcgtattcgtaggtggccagtttggtgccgtcggcggtgttcaggttgcgggaggtggggcggccgaggatgtcgtagctggtgaagatcctggtgccccgggcgtcctcggcggacacgggacggtcggcgtcgtcgtacgtgagggtcgacgcacccttgtcggggtccaccgagcggatctggcgacctcggagatcgtattcgtagatccagacattgccagccgggtctgtgatccgagtcagcttcccgtcggtgttgtacgcgtaccgggtggcgtcgaagtcaccctcgggcttggttcccttgtacttgcgccgttcgaccgtgtgcccgagggcatcggtgaggacgctgctggccgtttccccgttcggcggggtggtgtcggtgcggtcggcgccggggtaggcggtggtggtgcgccactgctcgatcgccttggaggagaaagtcttggcgaccggacggcctagcccgtcgtagaacgtcccactctgggccggaaccatgttctcgttggcgatgaagcgggtcttcacgggatcggaggtggagttgtagtaggagtcgttggtcttgaaggcacggccgtggctgtcgtagtaggtatcggtgatcaagcggcttcttgccgctccgttccgcggggtcgactggacctggacctgctgtccgaacgcgtcgaggatggcgatggacgtcgcgtacgactcgtccgagcggagcgtctgggtggtgacagagctggtggcggtgttggtgaggtcgtacgtgaaggtcttgctggcgctcgcgccgcgtgcgcggccgggtagccagacggccgtggtcctgccgagcgggtcgtaggtcagctccgtggtgcggtcgttctggtccacggtcttgaccggcaccgcgcgcagcgggtgcagggtggtcgtggtggtccagttcttggcgttggtgaccttgaccgtggtggcgggtgccggtgcggccggctcgtacacggtcgtggtcttggcgccgacggcgtccgtggcactggtgacacggccgtaggcgtcgtaggcggtggtgctcttcaggctgtacttcggctggccggcctcgaaacggtccagttcctcagtgctggtgacctggccggcgccggtgagggtgccgtggggctggccgtcgtagtacgtgcgcttgcggctgagagtgttcgcctcggtcgcggtggcggtgcagtcactgccccgccattcgacggtttcggacacgcggtcgagcatccaggctgcggtgttccgggcgtaggacgtcacggtgcaggtgtccgggaggccgtccacccggtccaggttccagagctccatgccgtaggtgtcgtcgtacttcgcggtctccgaggtggtctgccatgtcttgtcggcgcgcagcttcttctcctgggaagagccctcccgctgcatctgtgcggtgagcgcgggaagtttcgaaccgcggctgtgcgttgcggtagtggcggagagccacggctccttcttggacacggtgacgagttcgccgccgtcggatgcgtaggtttgggtttcgcggacggtgccgacgaacgggttgctgtccttgaccgcgttccccgtgaggccggtgaaggtggcggtgcgcttggtgccgtcggccttgacgtcaccgtccatgccgcgcaggtagaatgtcgcggtcttggagacgacgtcgggggcggtaccggcgcgggtgatgacctgctcgtagccgcggaactggttccaggtgcggcgcttgtcctcggtcagttcctcgtcgtcccggtgccacgcggcgccgccgacgtactcgtaacgcgtctcttgggggcgggagccgccgaaggggtcgagttgggtgacgcgggtgacgacgtacttgtggaaccagtccagggtcggatcgttcgggctcttgtcgtccgggttccagtagaccgggtaacagcgggtggtgttggcgtccttcgaggacggcaggccagcgcccggcgcacagtccgggtccgcgtatccgacgtcgatgacctggcccgtttcggacgtgatgccgacgatgcggcgtcggttcatcgcgggcctgttgtcggaactggaatcgacgcggttgttccgcaatgcgccggtgaaggtgacgggcatggtttcgaacgtggcttcgccgtcatgaccggtgcgggtcagcgaggccagccacagtgcgggcgccgtgtggtcttccgggttggggaactcgtgcttgagctcgtagacatcgacgtcgacgtaaccgccgctggtgttcaggaccttcgtagtgatcttggtgaggcgtttggtggtccagaacgtggcggaatagttctcgcaggtgcccgtgctcgcgcagttctggtcgaaggggacgtcgggccacttcgttgcgttggccttggtcagtttggccggggcgcagtcgaagccgtccttttccggaaggcagcgctcggacgtaccgaagaccacctgggcggtcggcttgacggtgtccgcgtcggtcagcttcgaaccataggtgatcttggcgaggttgccgccacggatgtacggggtgagatcacccttgggcgtcgcctccgacgctccgcgcttgtagtggttggtctccgtgtcgtaccagtgggtgatcaccccgccgcgcgggtcgacgacgaagtcgaggttccagcgccaggcctgctggcaccaggacgcggcgaaggtggactggtggcactcctcgccggcgttgttgccgtagaccggtgtggtccaggcggagttggtcggcggggcggtggtgctgcccggcttgcggccggcgccgaagtagtactgggtgccgtccgcagtgattaccttccagtactcgcctttgttgtcgccgttggccgcgccggtgagccgctcaaccttcgacgcgtcgtcgtcctcaagccgccagtcgccggtcgcgtcgttccgtaccagggccgaggacttgccgttcaaggagaggacggcgttgtggcccgccaggcactgctcgctcgattcggcctgaccgtccttggcgcacggcttgaaggcccgttcgacgaagccgggcgagtagtcccagccctcaccgatccacgaggcctggttgttggtggcagcggtacggccgtcaacggactgggagttgtaggcgagggagacggtgggcttggcgccacccagtccgtcgggcaccgcgatcgggtacgaccaggagaaccctcccgcgctcccaccgctggcccacttgcccgaaggtgccaggctggtggccgcgtacgtacccgcggggccgcccggtgccgccgacgcggcgatcacggtcgccccgcccgggccgcccgaggcgccgctcgcacgtgcaccgccctgtgcggaggctccgccgaaggccacctccgcgctgagcagcccagcacggtcaccgtccctggcggtctgcaggggcgtctgcgtacggcactcggcgcgctcgggagtggtcagcgcacattcggggagggcgacgaggcgggcccgggagagccagtcgccgccgaaggccccagcgatgaacgagacgtccaccgaaactttgaccgggccgccctgcaccgtttccccggccggcctaaccgcgagcagcaggccctggacgccggccttctccgcggccgaccggtccgtgagctgtacggcggctttgccggtgcgcggcgcgcccttggcgggggcgggactcacccagacgggagcagcgcccgcgcggctcgggtcagcagcgggagccgccgggacgtcggagggggcgggcgtcctgaggagcgaaccacggggaggggcgggtcgcgcggcgcccagatccacctcggcctgcgaggcgggtggccaatacacgtccttcgggctccaggccctcgccccgtcccctttcggagcctttgcgtccgatttcggggcgctcttcccggggaccgattccgttttctttaatacccctggtgaccagcggcttctctctttgggctgccactgcgcggcctgggccgtgcccgagcccactatcagcgagagcgccaacaatgcggagactgcgatacgctgttcgatcttcgcgtttcttcttactggccgaaaccaagccgctggtaccgacacggcattccccccacggtcgccgagtggatcaattggcctgggagcctagcgtgttagcaaatcgcaaaatgcagagcaattcggacaaggcgtgccccaccgacacacccaccccgcaaatatgtccgaaaagagcccgcaggctcagaggttgactcatttgcatcagtcaattgatcacgattatgggaataaattccaaggaatatccgattccatattcgcgcccacgagggatacggcaaaggggctgttagcgttcacgcccagttgacaggcagcaatcaaaaccggggagtttgccgtggggggcacactgagaaagaggcgaccagccagctggccgatcgccattgcggggctggtcacactggccctgcccatcacgtccgtcggcgcagcaccggccgcttcagcggcaccggcggcgagcaaaccggccgcaccaggagcacccgcagctcaggcgccaccgaagcggccgacgaccgaacgggaggccgcggaggacgcagcgctctcggaggccaagcgcactgggaagcccgtgcccgtggcggcatcgacgaccgagaccgacaccgtggcggccaacccgaacggctccctcagcctgacccgcagcgtcgcccccttgcgcacccggcgcgacggcaagtgggtcgacctcgacgccaccctcgtcaaggcggccgacggcacgctccgcccgaaggcgaccgtcaacggcctgaccctgtccggcggcggcaccgtgccactcgccgctctggagcaggacggcaagcagctcgtgctcagctggccggagccacttcccacacccgtactggagggcgacagcgccctctaccgcgaagtgctgccgggcaccgacctgaaggtgacggccgacaaggccggcgggatctcccagatcctcgtcgtcaagtccgccgaggccgccaagcacccgaagctcgccaagctgaccacgggactcaagggcgaaggcgtgaccgtctccgccgacagccacggcaacctcaaggcagccgacacctcgggccgtacggtcttccgcgctccgaccccgacgatgtgggactccaccgccccgatccaagctccgctcgccaagacctccagctccaccgcgttctcccaagcggccaagggccgagggtccgcgccgaccagcgcggacgaagaacctgcccggtccgtctccggcaccgacggccccggcgacttcgccaaggtcgccccgctccggaccgatctgggcaaggactctctcgccctggcaccggaccaggccttccttgccgaccccgcgaccgcctacccggtgtacatcgatccggcgtggcagcccaccagccgcggcacgcagcactgggcttgggtccaggaggcctaccccggcgccgtgagctacgacgactacagcgacacctacgatccgggcgtcggctaccagcgctggcggcccagaaccggactggagcgctactacgtacaggtcgacaccagcgacctgggcgacaagagcatcaagaaggcctccttcttcgcaacccagtcgtatgcggcggacgcgacgtgcagcaggacgtacgacgtggacctgcactccaccgaaccgctgctctccgacatcgcctgggacacccagccccgcgactgggaggtcatgcgtaccaccgcgatcaacagcgcgggcggccccggctgccccggctccacgacacgcggcgagtgggacgtgcgcgaccacctcgccgccaaccactggcgcggcaacctcacctacggactcttcgcctccaacgagtccaagagcggcagcaacaactccttcaagcggttcacccgcaacaagaacgacctgccgttcctgtacgtcgagtacaaccggccgccctacgacccgtgggcgctcggcacgttccccgcaccacagaacccgaacggcaacggctgcggctgggtcggagccaccaactacgccggcctgagcatcggcgcctggaccggagacccggacgggcagaccaacgacgccattttcgaggtcgtggacaccgccaacggcaccgtggcctacagcagcggctggatcggggccgcgagcggaacccactggatctccgcccatcccaccggcctcaccgacggccatgcgtactcctggcgcgtgcgcgcaggcgatggcgacatgatgtcggtcaactcgcccgctgggtgcaccttcagcatggacacccaacctcctcccgtccctctcgtcacctccgccgagtacccgccgtccggcaccctgcccggctccaccaagcacatcggccagagcggcaccttcaccgtcaagtccaccgacgccctcagcggtgtcatgtactacgagtgggctttcaactcggcgatcccggtcgggggcgccaaccgagtggaccccgcagccaacggcagcgccgccatcccactgacccccacgacatggggcaccaacatcctgcgtgtccaggctgtggaccgtgccggtaaccgctcacagcagcagacctacaccttctacgtccccgacgacccgaacgccaagaccacactcggcgacatcactggtgacgagcgtgtcgacctcattgcacctggagacaatggcgatctcatcgtctacccgaccgccaccgacccggcagccggtggcgtcatcgcctccaacgtggccaacagccccggcggcaagggctgggggccgggcactctgacctctcaccgcggcggcaacggcatccgcatcgacgacctgtgggtccatcgcgacggacaactcaagctctaccggaattccctcacccaaggcggactcgccgccaacggcggcctctactaccacgcggccaaggccgtgtccgtgcagcggccctacgcggaggactgcaaggtggccgccaccggtcagcggtgtggcatcgagtacgccgagaactggacccgcgtcaaacagatcctcgccgtcggcgacgctctgccggaagcaggtgccacgccgcgcaacgacctcctcaccgtggagaacgacggcacgaacagctcactggtgctgttccaaggcaccggcgcgaccggtgagctgcgcgatccgctcgtgctcgtgctcagccccacgggctgggacaacctcaccctcatcgcacccggtgatgccaccggagacggcctcccagacctgtgggcccgggacaacaccaccggtgacctctaccagtacgccaatgccgccgggaaccccgcggcccttggagaccacaccaaacgcaccaagatcggatcaggcgtcacagcggccacccacccagtcgtcggttcctccggggacaccagcgccgacggtgttcccgacctatgggccctcgacagcctccaccggctccgcacctgggacggcaccgccactgccgggaaggtcaccggcttccgcgccgctcacaccatgggcgacgcccgcatctccacctcccagtggaagctgaacgaagaagtcggcaccaccgccaccgacctacggggccgcaacaccgccacgctcagtgccaccggcgccacccgggccgacgacaccgtcgccggcaccgccaccaaggtggtcacccttgacggcaagtcgggcagcgtcaccgctgccggccccggcgtcgacaccacccgcagcttcacggtgtcggcctgggccaagtcggacaagccgtcggtcctcctcagccaggacggccagcgctccagcggcttcatgctctggcacgacggcgacggcacctggcgcttcgcaatgtcggtcaaggacgacgacaactgggcctacgaccagaccgccaccatgaacgacgcggccaaggtgcaggtcggcgtatggacccagctgaccgcgacctacgacgccactaccggcttgatcgccctctacgtgaacggcaccctggccggcaccggacatcacaccaaggccaatatctggaacgccaccggcccccttgtcctgggccgctacaagtaccagggactgcccagctcccactttgaaggcaagatcagcaacgtcgcggtctaccctcactccaccgtccccaccaccgcgggcgccggtaccaaactggtctcggcattgagctcggccaagtgcgcggacaacaacggcggcagcaacgccgatggcaaccgcatccagatctgggactgcagcggcaccgacgaggacaccgcccagaggttcgaggtcactgcgaacggtgaactccgcgtcggcggcaagtgcgtgaacgtttcaggaggcggaacggccaacggcaccccggtcctgctggggacgtgcgctaccggcgcctacaaccagcagtggctccccacggcgaccggcggcttcgtcaacccgacctccaaccgctgcctcgacctgccatacggacaactcgacaacggaacacaactccacatctgggactgcaacagtggcaacaaccaacgctggtacgcacccggccttgaaacacccctagccgcctaaccgcctaaccgccgagcccaacctgccggcccgccttaccgcaaccgcggaggaggcgggccggtggtttcgcatacacgcgacagcacaacgcaatccaccggctcccgccctctcgcagaacgccaccagccaccagatacatcccgaggcctgcagtaacgcccagcaagagctctgccactctgtcgcccatcaagccgttccaccccttcaatggcgtcggcgagccggtcggtctgcaccacggacagatcggcggtgtgcgggacacggaagtgcccggtgaggtgagccttgcgtgttcaccagtcctcagccttgactggaacgtcacccccgagcctcactcacatccgtacacccaggacacagccgccctgcggcttcctcggccctacggtgaggcagaggtggaagcctgggtccacggtttcgacgaaggctggatcaacggagccgtcctgggagacagcaaggcccctctggcccggatcgcggtccactggttcaacctcccccggctcatggggcagcatcacctgaccgatcggatcgagggtgcggatcggtactggtcccggggccgctggtcccacgaggtcgacggctggaagatcgtgctggacgtgcgcccggaccaccgcgtgtctgggaaggactcctcaagaaccggctctacgcgatgacgcacgtgatggaatgagatcgccctggatcgcccgttgtgcgaggctcgccgggctcgaaagcattgacgtgctcaggggagcccgcacgatccgagcacgtgggctcaggccgcccctgtcgggcagatcagagctgtgaaaactggctcgcattgctcccacctcacctgtcaaatcatgatcaaatggcgccatggtgtgggatgagtgggacaaggcgaaggcagatgtcgccggcgagcgccaggtgtcgatgcgcctcaaccaggtgaccagcggacctgatggcggtcaggccgacctggtcgtacaccaggatgacctgggcgaagtgggtcatgaggctttcctgctgcatggccaactgcagaagcaggccgacatcgccggcgccggtgccgacggctcaggaagcggctccacgatgcaggccgcaacatccttgaagacggccggcttctcactcggcggcgagctggagaccaccgtgtccgtgtggacctctcaggtgaagacggtcctgcaggcatgcgcccacatctcgaaccacctggactactccaagaaggcgcacgccgcggacgacgaggccatcgcagcctcgctccgcagccgcgacggctcggccgtgtccgtctcccgtatcgacgagtacctcaagtaggggcacggcatggactactcggacctcatggaactggacctcacgaagctgggatccgccgttcaggactggaagcgcacggccgacgctttgcagagcctgggcggacaggcgcgcgacggggcaaaggccaaggccgagaaggcccgctgggaaggcgtgaacgccggtgtgacccgcgccttcgtcggcaagacggtcaaggagatagagggcctccacacggagtccaagagcatcttcagcatcctccaggacgcccactccgaactggtggccatccagcagcaggcgcagaacgtgaccgccgacgccaaggaggcaggcttcaacgtccgtgtggggcaaggcggagcggtgacgatcgaggatgccctggtctgcgaggtggacggtcccggccagcgcaagcaggacctcatgcgctggtacgccgacaccctgagcggagtggtgagccatgcggccgaggtcgatgccgctgccgtacgcgctttgcgcggcagccacggcgcggatccgcacaacgccggccatgcgacgtacacctccctcgaccaggagatgctcccgcgagcactgaaactggccgggctcggcgaggaggccgacaccaaacagcggaaggagctgcagcggctctggcagtccctcggccccgaggcccgggcccagctgtggacccagcaccgggacgacctcctggctgccggcctgctccggcctcaggtcaaacaggtcgccgcggacgacggcgccggcccgtacgacgtcgaatcgccaggaatatcggactactggaaagagatccaggccaacggcatctcgaactccggcgacttcttgggcaagaccgacgcggcccgacacatggatcactacctcaacggcagcggcaagacgctcgatctggacgtcgaccgcatgctggccgacgacccggcgctccgggacgaggtggcacggatccgggccacagagcaggacgagtggcggcagcaggcactggacgccttcgagaagtcgggcggcaagcccgtcgccatccccgtggaatccggcagcagcggatacgaacacgaaaagggcccggatggtacgaacaactggtacctggccgtaggcagcggcatgaccaacacgaccggggtggtcaccgccgtccccggacccgatgggaagccgcaggtcagcatcgactaccaggtcaatgtgtgggaccgctacaactgggacggaaacaaggccacgccgatcggaccgaccaccgtcaccgatgccgacatggcccgcatgcacacgacaggactggccagggagttcgacatgcgaggaagcagctcggtacagcggcacgacctgtcggcaggagggtcctggcccgcacccgaggacaccgggcggagcggcacccgcacggacatcggccgcaattcggccgcccggtgatccgcgcacgacgcccgagccccgctctggtgcttgccatggcaacggtgctgctcggcgcgctcgccgccggatgcttcggggcgtccggcggtagcggcagagaaggcggccgctccgcagacccggggacgtccgactgggtcgagggagccaccgccgagtccgtcgcacggaccctgcacgtggaagtcccctcgacagcgacccaaaccgcggcagcgcaccgcagggggttccaggacgacgggttgatcctgtccttcgtcctgcccgcggaagccgtggactccttcctcacccagctgaagccggagcagcccctcagactgcgcgcgcagcccttcgccgccgaggcaacaccggccacgccgttcgcacgcctggggctgccggaaccggattcgcttcccaaggtcacggaggggcaggtgtgcgctccctgcaagggcgacctgaactggctcaaggtcgcggtggcgcagatcgacgaacggaccagccgcgtctacctgagaggggtcgactgacgcccgcacgaagccaccgtgcggtctgacgcccagccgtgcgaggagacagcggcgttgcaagcacacgtcaaccggtcgcgccccggcagggggaaggtcggtccagtcggccttcgccgccagggcgctggcccatcagaacccccaggccagaacccccaggccccgcgcccccggcaatgcatgcgaccactcccagcacaatccaaggcagctcacatcacgcaagcgatgtctggcactcctcgcaccgcctgatcgcctgccgtgcgatgtttccctcggtcgcggtcgccggatagctactgctcaaccggtgccacagcccggccggaggtgtggggatccatccccagcgcggggcggtcaccagttcctcggtcagatgggtgcaggccccgggaatgtgcgcgtactgcgtcggtgagatcagaatcgtgtccgcagggaagcgtcgccactcctgccggggcgagggcgctgggcgggcttttggcgtggatccgtcgggcgggcacgcacagcccagcccgatgatgaagtcgcagcgctcgcaacgccattccttcacggccccgccccaccctcacgtcgtaccggtgtccacacggtagacgatcttcccgtcgaactccgcgaaccccaacgacttgtagaaggcgcgcgcgccgggattgttgcggtccgtcatccactcgacccggctgcatccaggacgtgctgaggccagggcgcggagctcgtccatgaggcgggcgccgacgccctggcggcggagggtgccgcggacatagagctctttcaggaagagagagtaggaggagccggccgccggccagaggaacgagtaggcggcgagcccgacgagatcaccagcctcgtcctcgaccaagagagcggacgccaacggcggggagccgaagagcgcctcctccacctgggagcggcgctcctcgagtggctggatctcggtcgatccgtagaaccgttcgatctcctcgatcagatcggccactgccacagtgtcgcgcctttcggcggggcggatcgtcacggtcatcgacatctcctgtcgctctttcatcgtttcactcgttcgttgcaataggtgatcctggcgcggcggcacggctcgtggctacgggggcgtcagtgcctgaggagcccagccgtgctggcgcagggagtcctgaacatgccggatgaggtactccagatccgcgcagtagaccgaggggtttcggtagccgcggtcagtgctgaagcggtgcggtagatagcccccaccgcacacctccaccagaggacagctctggcactgatcggcgagcgcggccttcccgttctgccggtgcaggagcttcggatggtgaaggacctcattgaaggactggctgaagacctcgcgtcccagccaggaggcgccttcctcgacggaccgcagggtgtccacgccctcgatcgtgccgtccgactcgatcacgatgctcgtcggcggggccaggccgagggactccaccgagctgtgcaccccggagctcagcgccacgatgtcctccagcatccgcacactgtgccgctgctccggccgggcgagccaggcgtcgtagacgcggctcatccacaacccgtactcgggcacactcgggtcgtcgcgatgcggcggctcgtcgtgcgtcccgtgcggcaggccgaagtcgatcacaggcggctcgaacgacgccaggtagtcgtggacctcgaccgggtcgttggccaggtcgacgacggcgagcagccctgcgaagaggtgaggccgggaacgcaggagttcgatgccgcgtacggccgaggcggcgctcgatcgcgaggcgtgtgtcagccggtgccggtcattcgcggtcggcggtccgtcgaggctgacgcccacgacgacctcgtaccgctcgaagaggtccagccacggctgggtgaggagcgtcccgttggtctgaagctcgtaacggaccgccacaccggccggaacaccctcctgtacggcgccgagcaggtctgccatgtgccgggggccggtgagcaacggctcaccgccgtgcagcacgacgtgcacgctccgcaggccgtgcaccgctgcgtgctcaccgattcgcagcccagccgcccgggccacgtccgcactcatccgagcaggcagttgccgccacgcctggtcagcggagttgaagacgtagcagtagtcgcagtcgatgttgcagcgattggcaaccttgaggatgaacgaccgaaagggggcaacgtccgcgcgcggtgtcatcgagcggaacggctcacagaggccaggtccagatcagcgaagcgtggtgaccaccctcgccggcgtggttcgacgccgtctgctcggccgccagccgctgccgtacgcggacggcgacacgatccaggacgaccgaaccgttgatcgactccgcgacgacgggcgccggagcatgtggtgcgggaacgggcgtacgtgacggcattcgacgctcctcggggcagtgcaacggcgattgaggcggcagaccagcccgcaaggtagcagcgccgctaccctcggcgacatatcgaatccggccacgtgccccgctactcggcctgcgacgcaatgatccgctcgacgacatctgccgccccgccgatgcccaaccgtcggtacacatcgcgcgcttcacgcagcgccccttcgccccgcgcccgttcgccgaccgtccagtcgcaacggccgatcccctccaaagcccgtgcctcctcaagcgggcagcggatgtcgcgggccagccccagcgcctgctcgaagagtccgcgggcggcagcccagtcaccggaggagtgcagcagcgtcccccagtggttcaggacctccgcctcaccgcaccggtcgccgaggtctcggaggatgtccagactccgccggaacgactcgacggcaccgtcccgctcgccggcgaccccgcgcgccgcacccagctcgcccagagcggcggcttcgccaccacggctgccgagatcgcggtacgagcccagggcgtcgtccaacagacggatcgcctccgtgacgttcccgtccatgcggtccagtaccccgaggtggcgaacgctgttcgtgcggccgaaccgttcgccgagctcggtgaagtactccagtgcctgggtgtgagcctcccgcgctccggtgggatcgccggtcaggcgccgtacgactccgagctcgttgagggcgtatgcctggtggacccggtcgtcgagttcctggtagatgtcgaatgcctcacggtggcgctgcccagccagctgatactcgcccaggagacagtgcacgatgccaaggtcccgcagtgagttggcctccccgtattggtcgcccagctcccggtagatcgccagcgcttcggtctgtgccgccaccgctgtgtcgaagcggctggtctggcggcgcaccatgccgaggtccgcgagcgcgttcgcctggccgagacggtcgccgacttcccgatagagcgcgagggcctcggtctgcgcctgggcagaggcgtcgttgtccgctgtcatgtaccagacgatgccgacctggttcagagcgtcggccttgcctcgcttctcgccgaccgcctcgtactccgtcaccgcttcgttcagtgcctcgatggcctcggggtaggccgccatgaagcgccggacgactccgagctcggccagcgcgttggccagcgcccgccggtcgccggtgtgccgggcggcctcggcggcggtccggtggaggccaacggcttggtcccagggcccggcctgccgcaggaagggcgccatcgccgcagccatgtggatcaccaactcgtgcagcgcaaggtcgtttgcccttcggatgcaggccaggacgttggcccgctcgtcctccagccagccgagagctgccgtacgtgaatcgatgggaggggtctcgacttgggcggcttcatccggagggttcggagtggaggcgccgctgcgggcaatgtgtctgttcgcgacagcgagggcggccaggtagtaggagcacacgcgctgaacggcatgaacaggggccatgctgcctccctcgtcggcgagaccgcgggcatagtcgcgtaggaggtcgtgaagccggaaccggcttcccgggtgttcctcgatcagatgggcgtcgtagagcgtgtcgagtccctcgcgtgccgccgccaccgagaccgagccgagcgcggccccggagaaggcatcgagctcggtcccagggtagaggccgagacaccggaagaagtgctgccgctcaggtgtgaggtcctggtaggacaggctgaacgtcgcggcgaccgcgcgctccccagctcggagctctcccagccggtccccggcggtgaccagacgcgcacggagatcctcggcgctccacgacgggcgatggcgcagccgcgcggcgagcaacgacacccccagtggcaggtacccgcacagctccaccaactgctcgaggacggaccgatcgagcgactccggcgaccgcccgctgaggcgtacgaacaggtcgaccgcatgctccgccggcaacgcctccactggcaggaccacctcctcgtacgcagccaaccgcttccggctcgtcaccagcacgagacagtcgctcccgccgggaagcaggggctccagctggcgatagctggccgcgttgtcgaggatgagcagtgccttcttgttcgcgagctggctccgccacatggccgccctcgcctcggtgaccgcacccaggtcgtcgccgacaggaatccgctgcgccggcactccggtcgccgccagcaacgatgcgagcgcttcggtggcctgtacggggggccttcccgtcgtgtgcccgttcagattcacgaagagctggccgtccgggaaccgctccgacagcacatgtcctgcgtgtacggcgaacgtcgtcttcccgactcctggcattccatcgatcacatgcacaggcagcgcctcgccgctctcctgcgagttccgtacggaccgcaccagcgcctcgagctcggcggtccggtcggtgaacgcggtggtgtcgcgcggcagggaccgcagcacgagggcagcacccggaggcaccgccccttcctctggctggggcgtcggcgcagcgcggcgttccggcgcccccgactccgacagcgcggcaagcagcaccgccagcccgaccatggccccgccgagcaaagcgaacgagaaccagccatgccgctgcaaccaccccagccacccgggccactccgactcggacacggcgttggtgacgagccccacgagcatggtcgtaacggctccgccggcggccacgacggcgacggaaatcccccgccggagcctcatacgtgggtcgtcttgacggagcagggatgggtccgttcgtgctggccgcctgtggcgcggcacagctttccagctgtagctctggtcacgaacgcaacccccgaatccgacgccctatcgcgcataagcggaccagctctcacggaccctggtcaaggtcagctccccgccacacaccggctcgtatcagccaacctgtgcgtggcttctaagtcgggcgcaccgacgcccctttcacggagccagccagatgaccaggtgaacgtgctattgatcgccagcggagagtgatcctcgacaacgggtgtgtagtcagccctggtagcgtcgccgaacgcatgatcacgggcgcccctgaggggccacaggcgtctgacctgctcgacttcactcccaactccgcggtgtcacctgcttctgcttcgcctgctccagcaggcgcaggcgagaactgaatgacggctactggtgattgctcaccccggaagagccgaaggccgtgtgcgcgttctcaccgccccagccggtcggattgcgccagatgacattgacacggaagacatcgcgaatcgtgtctacagaccagtcttcggcaggcggttcggagaggacgaggtagagaccgtcagccagcgcgggcagcgtgtggttgatctcgagcaggcgggtcgcgcccgatcgcaggtccacataggtggagcagcctgcgcccagggcctcgtagaggaagagaccgtgctgggtaacgcagctgacgtcgacgaccgaggagtcggccggctggaggtccgcccagagaagtgatgccttcagcgcatgacggaccgcctcgtgcttcctgcacgtacggtcggccccggcagccgcttccagcgcgcggaggaaaccgtccttcgtggtcgcagccggtgttgcggcggcggtgtccgcggtggtcatctgcacctcttccttctgatctggttgggtcggggcgacggggatcgcgccgtcagagttcggcttcgtcgccatgctgaagcgctcctggagctctcgccgtgcttcagcgaggggccctgcccagccggaagcatccagcccctccgcgagtcgacctgcgtcgaaagtgccctccttgagcgcacggttggttgtcgcggcaaggtctcgaagaactccgagtcgctctctgtccggatcaccgaacagatgaagtacatcgacccagtcagcctggtcccggcgaaggatgcggttggccatgccctggagttcggagaggcggctgcgggcgtcgggaacgtcgccgtcgctgccggtcagctctcccagcacgtccagcgccgcgagatagcgccccgccatccgttccgagacgggcgaccggccacgctgatcggcggtgagcaccgtctgactcgtgtcgttcgcgaacacccagcagtccagctcgtcaccccggcgcgggggaaccgatccttggcggacggtgagcacgagcggccgaccgatcaccggagacaacggcctgaccttgtaccgaccgccagagacgtggcctacgacctcgacccggacatcgctgccgatccggggaaggctttccgccgcgcccgccggccggacgtccggtgccgcgggttcggcgtcgtccgcggaggcggtgagcgcctccggcaacgcggcggtgtgcaggacggtcaggctctgggtgctgcgggtgagggccacgtacagctggcgcagcccggccggaccacggtcggcgatcgtcgcgggctcgacgaccaggacgtggtcgtactccattcccttggcctgcgaggcggccagtacggacacggcatcgcgaccgcgctcggcgatgtcgctgccctcgtggatccggtggctgatggcgtccagccagtcggagtcgtcggggacgatgacggcaacggagcgggggttactgccgtcgctggtgcgcaccagtcgtgccacgtgggcgacggtgtcgtcgagcagcttccacggttcggtcgccacggtccgcacggcgtccacgcccgcctcacggacagcctgtggatatggcagggacggggcgaccacgcgggcgagaggggcgacgaactccatgatctcggcggggacgcggtagctggtggtgagctgagccacgctccagtcgccgtggtcggaaaggagtgcgcccagcaggtcccagctcgtcgggatgtgggcgcccgtcgcctgcgcgaggtcgcccaggacggtcatggagccgcccacggcgcagcgccgccgcagggagcgggcctgcatgggcgtgaggtcctgggcctcgtcgaccacgatgtggccgtatcgcggcggggtctcgccgctgatcagcacgcgaagctcttcgaggcagacgtggtcgtcgagggtccaggggtcggcgtcggcgctggcggcgcgcgcccgcagcagggccgtccgctcgtcctcgtcgaggatgccgtcggcgcattcccgcaggaggtcggccgagtcgtagaggctgcgcagggcctcccgggggccgggggacggccagacgcgttcgacgaggcgctcgacccgccggttgcgttccaggtcgcggcggatcgtgccggcctgtccgcggcgcggtgcgacatcggcgagctcttggagaagccggtcgacgaacaggccgcggaagcggtcccgccgctcccggaagggcccgtcgccggcgtgagcctggtcgaggagggcgaggacctcggacttcggcacgcggagggtcgtactgctggcggtgacgacgaccccgggctcgtcgccctcgtaggagggggcgacggtgagggcgtcgagggcctcgggacggtagtcgctctcgacccggcgccgcagtacggccgccatgccttcccttgacttcgccagacgcgccttcggggagtccacaccgagggtctcgccctcccacaggcggtccagctggacggcgttgacgtcccgggtgccgagggtggggaggacctggccgacgtagtcgaggaaccgttggtgggggccgatgacgaggatgtcctgggccttgaagtgctcgttgttgacgagccaggtcacccggtggagaccgaccgccgacttgccggtaccggggccgccctgcacgacgaggatgtccgagggcgagccggtgaccagcgccatctggtcgcggcggatggtctcgacgatgtccctcatccggccgccgcgcgaccgctggagctcttgcagcaggaagtcgtccggctggggtgccttacgccgctgccgtcgtacgacatcgccgggcgtgggggcagacgtaggttccggggcgggggacgcgtccgcctcctccgccgcgctgtcgtcggcggcctgacggggcaccggtacggcggcggactcgggtacgggtacgggtacggcctcgggagcgggtgccggcggggagatctcgtcgaagtagccctcgacgatccgctgtacgcagcgaagctgacggcgcaggaccacctcgcccgggctctcgggccgggcctcgctccaggtcttcgccagcgggctggtccacagcaggacaaccgggtcgttcgcgctgtccttcaccccccggcgcccgatgtaccacggccggggctctccgcccgggtcctccggggcgtcgacgcgtgagaagaccagcgcctcgtcgcccagtcccccgtaggcctcggcccgcgcctccgcttcggcccggttggcgatcccgtccttgccgctcgccgaggcggtggccgccgaggtgccgctcagttcggccagcttcgtggtgtagcagtcgtacgcgtggtccaccgcccgctgctcgccggcgaggatctcgtcccgagtggtggtgctcatgtgcgtcctccctgcggtgccgggggacaccgccacgggcatgtgcccgtaccccgtgaaacaactaccagaaaacggacggtgacgaacgatcagttgccgagttcacggacgagaccgccggcctcggcccgccagacccgcacctggtcgtaagtgggtccgaactcgtacaggtggtagtggcatcccagactcagctgggaccagagggccttcgcccgccgggccgtttcggccggcgcgacggagtgcaggaggagcagcttggcgcgccccgtggtgcggggcagaccgggcatcatggcgcccaccacccggtcgacgcacagctccagcgccgtccgcagcgcgaggcaggcgccgcggtgccggccggcggtggtggcgtcggcgagttcgccgtcgatgagacggtcggccgtcagcagcaggccttcgacggacgcgggaacgggggcggtcatgcggtcacctcgggcttgcggatcttctgcgccagcttctccacgtccgagacgaagccgtgcgggtcggggatcgaggcaccgccggcgtgggacccgttctggcactgcttgatcagcgaccatgccgcgtttccgtagcggcggagcacctcccccgtgatgtcgccgccgcgcttcacgtcgccgaagaaggcgaaggcggcgacctccaggaacctctccgcgctgtcgatcgcggcctggaggtcgtgctccgagccgccggtgcggtggtggcggatccacgcggcttccaggaacgcgttctccagggcgatccggcacaggccgggcagcacgtggcggtacgtctcggggggaagcccaggagtggcggcgatggcccgggcgtcgccgatggcctgcttgaccgggtcgtcgacgcagtcgaccttcacccgggacccctcgccccgcgtcacctggaagaccgtgaccggcagttcctggtcggtgaacgccttctgcagacggggatcgtgggtgaagacgacgacctgccggtgcctgcccagctcgtgcagcacctgggcgagtccgtgcaccttggtcggatccatggactgcacggggtcgtcgatgacgaggaagccgaaggggctgtccgcggtcgtggccctcggcaggaagagggagagcgcgagggagtgcagctccccctggctcatgacgtcgagcgccggagcgtcctggccgtcgacggaggccgccatgacgagcttgcggacggtcgccttctcactgcccatcaggctgacggccgcgaggtcgacgttgctttcctgccgcaggcgctgccagatgtcctgcgtggcgtcggtgaagcgttccatgcgctgccgccgcagctcggtggagaggtccttgagccacttcagcgccttccggaggtcgctcagcaggggcttgtcccgttcggtctggcgcgccttgtccgcccaggcggcgagccgggtgatgagcgcccgccaccgttcgtcgcgctcctccagctggtgggacgcatggctcctgacggtgtcacatgcgtcggcgaggaccttggcggctccttcggcgcgccgggcgagctcggtgggttcggtgatccgccggcagtcggtccactccttccacgggtcggccagtgcggcggggatcagctgggggttctcgatgaggttgtggaggttccgcttggcggtccggacggcgttgtgggcgtcctcggcggacttcgcctcgcggcgcagctccgccgcctggtgggaggcgcgctcgtaccactcccgtccgaggacccgttccgttccgcacgtcgggcagacgtcgtcgtcggggtgccggtgagcgtggtcgagggccttttccagcaggtcggcgcgcagccgggcgttctcggcgtcggtgccgtgcaggtcctccacgtcggcgagggcgttccgcagccgccggacggcctcctcgacctccgccaggtcgggtccctgcaccccggcctcgatccggagctcggcgagctggctgtcgtccgccggggggagaccggcgacgagggcgtcgatggtgtcgaggtccagggcgcccggggtgtccacggcgagcagggcctgtacggcgcggtcgtcgtcccccagcgtgtagagagcctccttcaggtcgggcagggcgtccttcatctccttcgccgtgttggcgagggccttctcccgggcgctcagccggttggtcgcggtggagagcagctccatgccgaggatggtggcgatcgcgtcgtagcgctcggacggcttgccggtgagcatgaggtcgaggtcggtgtacgagaggaacggccggtggtcggcgagggccgtgtcccagcctgcctcgggcacaggaacggtgccgtggccggggcgcttgaaggtggcttcggagctgccgaactcctggctcgcccaggtgcgggtgagggtgctgttgccggtgtcgccctcgatcgcgagcttgagctcgatcttggggctgtcggcgttgtggaggttgtaccagtggccgccgcgcgtggcgtcctggcccggccggtgggcccgggtgccggtgaagccgacctcgatggcgtcggcgaggctggacttgccggagccgttgcggcccacgacgaggttgacacccggacggggggtgaggctcagccgggcccgggggccgatgccgcggaagccgttgacggcgagggagccgaggtagacgcgtccgaccggggaggttccacgggtctcgttctcgcccagcgcctccttcagcagcgccatcacggactcggggagtaccgcctcgaccagacgggtccggaccagatcggccaggggcgggggctggtcggccgggtgcggccgagcggggtcggtgggttcgtccgcgttgagctggggctgttccgtcacggtcatgtgcgtctcccgggggccggatgctcgttcggagtgtggggcggacatcggcacgtgctgggtgcggatggcgccccggcgctcgcgtcgggggtccacagtgcggtggcgcagtcaactcacgcttccactcggaaccgcgactagataagcatagtgctgaaagcactgtcaaacggcttgatgaatttgacgaccgttgtaatgtgttaaccgtccctgtccgactggcccgagaggtgcggagccccacgccatgccccagcagccaccagcccgaccggcgccctcagcgcacgtgacggccgccgagatctcccgtatcgcaggggtcacgcgcgccaccgtcagcaactggcgccgccgccacgacgactttccggctcccagcgcaggcacggaatccagtccgctctacgacctgccggccgtccaggcctggctgcggggccgcgggcacacctccaccgcctcgccgaccgaggaactgcgtacggcgctccggctgctgggtcccggctcgggagtggccgcgcgactgttcccgctggtggctgccgtgtcccgccgcacaccggaggaactggccgaactcacctccgcgcccgacgaccagttgatcgcccgagcggagaagatcgcgggcgagcttccggtcgccgtgcccgaggccgagccggtccgctacggtgcggacgacgcgggtgcggtccgcgcgctgctgggttgcgtccgtgaggcgggggcacaggccgccgtcgacgtactcgccgagcgcgaactggacgagggcgccgccagcggcgtctaccagaccccgcagggcctggccctgctcatggcacggctcctgcccgccgacacgtcccgcgtcctcgatcccgcctgcggcagcggcacgctcctggctgccgccgcccggcagggcgcgcgggggctgttcgggcaggactcgctccccgtccagggccggcgcaccgcggtacggctgctgctcgccgcgcccgaggccgagactgcgatccgtgtcggcgacagcctgcgcgacgacgccttccccgacgtcaccgtggacgccgtcctgtgcaacccgccgttcgccgaccgggactggggtcacgacgagctggcctacgacccgaggtgggcgtacggggtcccgccgcgcttcgagtccgaactggcgtgggtgcagcacgctctcgcgcacctggagcccggcggctacgcggtcatgctgctgccacccggggttgccttccgctcctccggccgccgcgtccgcgcggaactcatccgcggcggggccctgcgcgccgtcgtctcccttccgacgcgggccgcgtatccgctccacatcggcctgcagatctgggtgttccaacgccccgaaccgggcggcacggaccgtacgacggtgctcttcgtcgacggcgagggcgagcagcgggacggcgccccgggcacggcgtccgccaccgagacggccacggccgacgccggcacccgtggcggctcacgcccccgccgatccggctcgtcctcttccgccgcctcttcatccgccgcctccttcgactgggcggggctgaccgaccgggtcctcggtcagtgggccgcgttcaccaccgcacccgacacctacgccgacgagcccggcgtctcccgcgcggtgccgctcgtcgacctcctcgacgacgtcgtcgacgtcaccccggcccgccatgtccgggcgaccgcgggcgacatcgacccggccggcctggcccgccgcgttgacgacctgtacgggcaactggccgagcaggtcgccgcactggcggcctcctccgcctccggcgggtggcagccgtccggggcctcagcccgcgagtggcgtacggcgaccgtctccgacctggcacgcggcggagccctgaccgtgctgcgggcggcgacgcccggcacacgaggctccaagagttccggcgcccccgccgtggagcggccggtcctcgccgcccgcgacatcgcggccggaaacccgccgtccggcacggctgtcgacatccacgcggacgccgcgcaacccgtagccgccggggacgtcctcgtacgcgccgtcgcgggcggcagcaacgcggcgccgatgacccgggtagcggacgaccgggacaccggcgccctgctgggtcagcacatccacctcctgcgccccgaccccgcacgcctcgatccgtggttcctggccgggttcctcggcgccgaggacaacatcgcctccgcgtcgaccggcagcagcctcgtgcacgtcacaccgggccgcctgcgcgtaccgctgctgcccctggaggaacagcggcgctacggggaggccttccgccgcgtgcacgaactgcgcgcggccgtccgccgaaccgccgacctcgccgccgacaccgcggccaccctggccaccggcctgaccgccggggtactcctgccaccggccggcccgggcactccgggtagccgttctgtctgaaacgccccacgcatcccaccgcacacgaccacactgaatcccagccgtcccacgcccggacggtgctctttcggaaggaagccgggaccctttgaacagcagcaagcacacggagctggcgaaccacgcctggtccgtcgccgatctcctgcgcggcgactacaagcagtccgactacggcaaggtcatcctgccgttcaccgtgctgcgccgcctggagtgcgtcctggagccgacgcgcgagaaggtcgtcgagaccgtcgacaggttcgcgggccaggacatcgacaccggccacttcctgcgcagggcctcaggtcactccttctacaaccggagcgacctcacgctcaagaagatcgcggccgacccgcagaacgcggcgaagaacctgcagatctacgtcggtgccttctccgagaacgcccgtgaggtcctcgacaagtacgagttcaaccagcaggtcaggaagctcgacggcgcgaacctgctctaccaggtcatcggcaggttcaccgacctcgacctgcaccccgatgtcgtgcccaaccacaacatgggctacatcttcgaggagctgatccgccgcttcgccgaacagtcgaacgagaccgcgggggagcacttcacgccgcgcgaggtcatcaagctgatggtgaacctgctggtggcgcccgacgcggacgccctcagcctgcccggtgtcgtccgcaccgtcatggacccggcctgcggcacgggcggcatgctcagcgccgccgacgaccgtatcctcgccctcaacccggacgcgacggtcgaggtgtacgggcaggagctcaaccccgagtcctgggcgatctgccgctccgacctgatgatcaagggccaggacccggagaacatccgcttcggtaactccttcaacgacgacggccacgcccgccgcaagttcgactacatcctcgccaacccgccgttcggtgtggagtggaagaaggtcaaggaggacgtcgagtacgagcacacgtcgctcggcgacgccggccgcttcggcgccggcctgccgcgcatcaacgacggctcgttgctcttcctccagcacatgatctcgaagatgaagccagtggacgtcaacggcgggggaggctctcgcatcgcgatcgtcttcaacggctccccgctgttcacgggtgctgccgagtccggcgagtccaacatccgccgctggatcctggagaacgactggctggaggcgatcgtcgccctcccggaccagctcttctacaacaccggcatctcgacgtacttctggatcctcaccaaccgcaaggacgccgaccacaagggcaaggtcgtcctgctcgatgcgcgcgaccagtgggtgaagatgcgcaagtcgctcggcgacaagcgcaaggagctgggcgacgggacgaacggccgccccgaccacatcggcgacatcacccggctgtacgcggaggccgcccaggtcgccaaggaccccgagcacccgctgcacggcaaggtcaaggtcttcgccaacgaggacttcggctaccagcgcatcacggtcgaacgcccgctgaagctgcgcttcgaggtcacggaggagaccttggctgcgctggcggaggccaagccggtggccaagctggagcggactgaggagttcgtcgcggcggtgcgtacgctgctcggctcgtcctgggcgacgaagtccgaggcgttcatcgcgctcaaggacgcggtggtcgcggccggcctgacgtggccgtcgggagcgccgttcgcgaagggggtacgggaagctgtcggggtccgggatccggagggcgaggtccagaaggtcaagggcgcgccggaaccggatgcggacctgcgggactacgagaacgttccgctaggcgaagacgtcgaggattacctcaagcgcgaggtgctgccgcacgctccggacgcgtggatcgaccacacgaagaccaagatcggctacgagatcccgttcacgcggcacttctacgtgtacaagccgccgcggccgctggcggagatcgacgcggagctgaagtcgctggaggcggagattcaggcgctgctcagcgaggtgaccgagtgacgctctggaataaagttcgcctgaagcacctttgcctcgacgctggccagtacggcctaaatacgtcagccgagaattatgccgagtcgggaacacgtctgctgcgtaccacagacatcagcagtggcacgctttcctcagcagaagagggtgtattcgtttccggcactccggaggagcgattcgcactcaaagaaggtgaccttctcctgtcgcgaagcggtactccgcctgggcagtcctacctcatccgcgctgccgatgagggcatgacctttgccgggtatctcgtgaggtttcgcccgcgacctagcgtagaccctcgctttctggcctatgtcgcccaaagcgcaccattccagcacacaattcgctcggaatcggttgcctccacgatccagaacttcaatgccgagcgttacgcgaacatcgagtttagggcgcctaatcccaccgagcagcgccacatcgccgacttcctcgacgccgagaccgcccgcatggacaggctgcatcgcgcgaccgaacgccaacagcaacttgtcgcagaacgacagatcgtggcattccatgacagcgttcagagtgaaggtgggcctgatctcaactcaagcgagcctgctaccaataactccggctggcgcatgctgccgctgaaccacgcgctgaatcagctgacgaatggatatgtcggtcctacgcgcgacctgttcgtagatgacggggttcgctatcttcagtctctacacatcaagaacggcagaattaatttcgcacgaaagccgtattttgtgaaaaaggattgggcagaagaacggccgcggattcgtctcggattcgaagaccttcttatcgtccagaccggcgccatcggtgaggtcggcctagtcgatgaggagtacgtgggcgccagctgtcacgccctacttatcgcgcggacccacaggagtctcctcgcccctcgatacctgtggcatgcatttcgaagccactggggtcggagtgcgcttttgcgggagcagactggggcgcttcacccgcacctggaagctggcaacgtgcgctttatgaagattcccgttccttcactcgacacgcaacggcgggtagtggcacgcacggaagagatcgccaaggacacggtgacagtcgagcgtgctctgtctcgccggttgacgctgcaatccgagcgccgccaggccctcatcaccgccgccgtaaccggccagttcgacgtaaccaccgccagcgggcgcaacgtaacggacggagtcaccgcctagccatgagccccatccatacggagtccgccttcggcgaggccatcgtcgccgccatggtcgagcgcggctggcgcgaggcgcgcccgcaggactaccaggccgatctcggcctggacaccaacgaactcttcaccttcatcggggcgacccagcccgacgagtggagcgagctgctcaccgtctacggcggcgacccgaacgaggcccagcgcgggttcgccggccgcctcgaccaggccatcgccaccaacgggctcctcgatgtcctccggaacggcgtcaaggaccggggtgtcctgctccgcgtcgcgtacttcaagccgaacctcgtcgcccacgactccgtgctggacggctaccggggcaaccgcctcaccgtcgtccgggaactcgagtacgcgacgaagcaggccgactggggcaaccggctcgacctcgccctcttcctcaacggaatccccgtcgccacggccgagttgaagaacccgctgaccaagcaaggggtggagcaggccaaggagcagtaccgcaccgaccgcgatcccaccgagctgatcttcacgcgccgcgtcgtcgcgaacttcgccgtcgacccggacctggtcttcgtcgccacccagctcaagggaaagaacacccgcttcctgcccttcaacaccgggtccaacggaccggggcagcccggcggcgccggcaacccggcccccaccgcctacggcacgtacgcgacctcctacctctgggagcaggtctggcggccggacaactggctggacctgctccagcggttcgtgcacctgcacaagagcaagacgcccggcggcggcaccaccaagacgatggtcttcccgcggttccagcagtgggacgcggtcaagaagctcaccgcgcacgccgccgcccacggcgccggccacgactacctggtcatggcctcggccggctccggcaagtcgaacaccatcggctggctcgcacaccgcctcagcgacctgcacaccccgaccgacccgcgcgagctcgaccccgaggccatagccaagggcctcaagccgggcgtgccggtcttcgacaaggtgatcgtcatcaccgaccgccgcaacctggacgcgcagctccgggaaacggtgggcaatttcgagcagaccgccggcctcgtcgtgaagatcgacgagaagtacggggcgaagggcgagcagctcgccaaggccctctcccgcgacaccgggaagatcgtcaccgtcacgctgcactcgttcccggcgctgctcgactacctccagcggaaccccacggagatccagggcagcagtttcgcgatcatcgtggacgaggcgcactcctcgcagtccggcgacgccgccaccgccgtgcggtccgcgctgcgcgacctcggcctggactccgactcggacgacgagggcgcgaccacggtcaaggccgaggccgccgcaaccctcgacgagcagctcaagaagagggccgagcagcgttcccgcgccgcgaacctctcctacttcgcgttcaccgccacgccgaaggccaagacgctcgaactgttcggcgcgcttgaggacatcgacggcaaggcggcctaccggcccttccacacgtactcgatgcggcaggcgatcgaggagggcttcatcctcgacccgctgcgcaactacgtcacgtacaacacgtactggaagctggtgaaccagaaccccgacgagcgggaggtcgacccgtcgaaggcgaacggcctgctcgcccggtacgcgctcacccatgactcgacggtcgcccagcacgcccaggtgatcgtggagcacttcgtggcgcacagccggggccgtctcggcggccgggccaagtccatggtggtgaccgcctcccggcagtccgccgtgcagatggcgcgcgcgatcaagagctacctcaaggaccgggactacgacaccaagtaccccgacctgggggtcctcgtcgccttctccggctcactcaccctcgacggcgaggagaccaccgagccgaaggagaacggcgggctgtcggagagcgcactgccgaaggcgttcgcgtacacacgtgtcgacgacaaggccgcccgggccggcggtgcgggccagcgcgagtaccggatcctggtcgtggcggagaagtaccagaccggcttcgatcagccgctgctgacgacgatgtacgtcaacaagtcactgacaggcatctccgccgtccagaccctgtcccggctgaaccggaccgcggagcgcaagagccaggctgacctggcggtcctggacttcgtcaacgacgccaacgacatacaggacgccttccgcccgtacttcgaggaggcgaacaccctcccctccgaccccaacctgctctacaccgcgcagagccgggtcatgcaggcggcgatcctgtccgggcaggagatggacgagttcgccgccgcgtacttcgccgccaaggagaaggctgccggctcacagtccaagtgggagaaactgcacgccgagctgtaccggctgctctcccccgccgtcgcccgcttcacgcccctgctcgaaagcgaggacacggacgaccaagaggccgcggaggatttccgcgccgccctcaacgactacgtcaggaagtacggcttcctcgcgcagatcgtcccctaccaggacaccgagttggagcggctgcacctctacggccgctacctcctcaaccggctgccgcgccgggcggacggcggcgtggacatcggcgagatcgacctcagccacatgcgggtggagaagaccggtgagtacgacgtctccctcacctccgagggaccgacgacgatgcagggcttcggcgacggctcgggcggcgccaaggaagcggagaagtcgctgctctcgcagttgatcgacaagttcaacgagcgcttcggcaccgagttcaccgagcaggacgtcatccgcccgttcgaggaggccaaggccgacccgaaggtgcgggcagcggccgtcgtcaacgacgaggagaacttcggcctcgtcttcgacaacgtcttcgcggacaagatggccgaccacatcgacaccatcgcgggcatgggccgccagtacttcggccccgacaagggcttcaagtccagtctggaccgcagcgcccgcaaggccgcctggcggatgatccgccgcgaagagggcctggacgacgacttctgatgtgtacgccccggccggaagcgccggccggggcgtccttcggagggcgacctcggctcctgcacggcgatcgccgtgctcaccccactacccctcaactgcgaaaagccacttcaggagcgggcaatggacaacgcgattcagctgatcagcgacggtgacggactggcggtcatcggggatccgacagatgtcgaacgcttcctcgcctcggagggactgccgtcgaaggacctcggagcaggacggctcaagtccgtcttcgacaccggggccgcagtcgcgcaggcaggttcggagatagccgccaactccggccgctgggtgaagctgaccacggagtccgcgcagcgtctcaagaagttcgggctgatggaaaccaagacgccgggcgtcagccatgcaatgttgggcaaacccggctcgatcaagtcatggctccagatcgagaagggagccggctcgtttctgaccaacccggcgcgtctggctggtgccgcggggatcatggcgcagctcgcgatgcagcagaccatggacgagatcaccgactacctcgccgcgatcgacgagaaggtcgacgacgtgctccgcgcccagaaggacgccgcgttggctcgcctgatcggcatggacctcctgattgaggagaccatgaccgtccgagagcaagtgggccgggtctccgacgtcacgtggtcaaaggtgcaggccgcgccggcgacgatcgcagagacccaggcgtacgcgttgcgtcaactcgatgcactcgcggagaaggtggagcgcaagagcgagtccaagatcggcgatctcgccacggcggccaccgaagccgagtccaaggctcaggagtggctcgccgttctggctcgttgtttccagcttcaggacgcgatcgccgtgctcgaactcgaccgagtgctggacacggctccggacgagctggaccggcatcgcctcgggcttcgggctgcccgacagaaccggctggacctcatctcgcggagcaccgagcgtctggtggcccggatgaatgcggctgccgccaccgccaacgcgaaagtgctgctgcacccgaccaagtccccggccatagtccagtcgagcaaccatgtcgcaaccggcgtccatgactttcacgggcggctcgggattgagtccggccgccggtcatcggatgcgagacgatgggtgcacgcggccgcggaggcgagggacaaggcgctcgagacaggggcaaagggcgtcggtgccgccagaagcctcggcaccgagaccctcgaccgggccggctcgatgaaggggaaggtctccagcgggatcgctgagctggcgcgccgtcggcgcgggaacgaggaggatctagaccaggaaggctgagcctgatccgtcggtcggcccccgattctccggagtggtggcgttctttgtctcagccaactgtgcaggacgcgggtgccggtgccagcggtcgcggccccgtgaccgcttgcgcaccgtgaccgctggacggcggatcgcccctgcggccacacttgacacctgaccatgactgttcatcacgcacaccgggggcaaggtgccgcaggaggcgatctccgaccgttacgaactcctggaggagctcaaccacggcggcatgggcgacgtatggcgcggctacgacgccgtgctcgaccggcccgtcgccgtgaagctcatccggcaggcgtcggtcacctccccgcaactggccgaggagttcgccaagcgtttccgtcgcgaggcccgcatcaccgcgcgcatccagcaccccggcgtgccgcaggtgtacgacgcagtgctcgacgcgtcgtacgagcgactgttcctggtgatggagctcgtcgacggtgtacccctgtccgcctacctggaccccggccagccgctgccggtcagctgggcggcagccgtcgccgcgcaggtcgcgaccgtactgtcgtacgcgcacgacgtcccggtaatccaccgggacctcaagccgggcaacatcctcgtcgcatgcgacggcaccgtgaaggtcctcgacttcggcatcgccgcgatcctgcgcaccgacgtcaccaaactgaccgccaccggcagccccatcggcacccaccagtacatgtcgcccgagcaggtgcgcggcggacgcatcaccccgcagaccgacctgtacgcgctgggctgtgtgctgcacgaactcctcagcggacgactcgcgttcgaggctgacagcgaattcctgctgatgtaccagcacgtcaacgccgcccccaccccgctgcggcagctgcggcccgacgtccccgaggcgctggaggagctggtcctgcacctgctgcgcaaggcgcccgaggcgcggcccgccgacacccaggaggtgtacgcgcggctgctgccgttcctcccgcctccgggccgggaacccggcacgacggacgccggcccgaccggcgcgcccgacccgacgggcgtcttccgtcgtcctttcgcgccccgcgcccgcgcccaggcgcccgtacctgatgacgtgcagcccacggccgtcctcccgggggcccggccggtgcccgttcccgcgcaactgcgtcaggacatcagggaggcgtacgcccattccgaggccctgttggaggaggagcggttcactcaggccgccgaggtgctcggcgagatcatcgaacccgcggccctcgccctcggctccgagagcaaggccgttctggcgctgcgccgccagcgagcggccatccgtctcctcggcggcgactaccgggccgccctgcccgagttcgaggccctcgccgacgcctacgcccgcatcgccggacccaccggcgagcagtcccgcgcctgccgcgcccaggcggcccgatgccgcgccgaactgggccaggtcaccgacgcgctcgccgcgctccagggcgtgctgaacgtggtgcgggccgtcgacagtgacgtgagcgaggaagccgtggagctgcggcacaacatcgggatgctgctgctcgcccagggccaagccgccgaagcccggcaggtcctcgaaccgctccatcaggacatgtgcatggtgttcggccccgacgacgagatgaccgtcgagattgccgcggcgctggccctgatccgcctggacctcgacggcgacgctgccaggtaacccgctcgtacacctcgcaggctcggctggagtcgctgaagcaggccaaggacccacacgtccgcaccctccgcatcgcccaggggatccgcagcgtcgccctcgctccgtggcgacatcttcgtgctgctacgcgtgatgccgcacgacaaggccatcgcctgggtgatcaaacagcgcgccagcctcgctgcaccgcttgtgagctaggaacacgcacacctgcatcgaggcccttcggccccctgtgccggtcgccaggtccagctccgcgacgaccgccttcgagccgctggccgccggcttccccattcctcaggcgttcgcgtggcgtccggccgtcaccccgaggcccggcgacctcgctcaccccgcgccgtctggtgcgctcgaaccttcggcgggcatcccttccacctcatcgttgcggtcctcaggagcccctgcaggaacggagcgcgaaagggcgaaacccaggacgagcatcggccattcagggcaccagggacagggcgcgccgaggctccgatgcggctcgctggcctccgccgccgaccatcgtcatcgtcaggccgaagagcatcttgttcatctcgtccgacgtgaggcccagctcggctgccaccgccgccggcttcattcccgtggaccgcaggccctggaaaaccttggtgagcacctgagaggtctcccgcttcttcatgccttcgggctccgccttgcggtagccccgctggctcagctcggtgcaggcggaacggtactgccagtcggtgagtagtccgaggtcgtgcatgcggtaggtcagggccatcgcggacacgttccagatggccttgcccttgaggatctgatcgacgtgtgccccggccggcatgtggcccagcacgctcgaagcgggcatgaggaaggcgctggcgaagtcgttcgcctgccgctcggcctcggggccggcgcactcgcggtcggtgccgtgcatgacgaggtgcccgagttcgtgggcggcgtcgaagcggctgcgctcggcggacttcatcgtgttcaggaagacgaacggggttctcccgcgccagacggcgaaggcgtcgacctccgcgtagtcgggcgcgagcgagaagactcggacgccgtgcgcctccagtaggtgcaccatgttcggtgccggggcgttccccagcccccacgtcgtgcggaccatctcggccgcggtctcagggtcgggcttgccgagagaggggaggtcggcgaccggcagacggaagcgttcctcgatccagtcgtagaggagcgcggccagcgttccggccgcgcgcgcggcgtcgagagtgcgggccggggtcttgcttcgagcacgccacgagatgccctcggcgggcagctcgtcgatctccggacctgtgaagaagtctcccgggaagccgagtgcgcctgcgagtcgctccacggtggtacgtcggggtgccgtccggccggtctcatagttggacaggctctgaagcgagacccccgcaagttgggaaagctcggcgagcgtcaggcctcggcgctttcgggccagcgtgatgcgggacggggtcaccatggtgagactgcctcgggatccggatggtgcgggtggggcggccagtatcgcggccaccccacatgatgggcctcagcgaaactcgacggagatgtcgatctcgtcgggtccatcttcgtccgacagttcgatttcgtccatctcgatgaccggcagcagtatccgctgctcccacttcacgacgaacccgcgatcgacctgcccgggcagcgacagctcgctgtggatccgcaccccgccctcggccttcactcggtacgagaccaggaaccaggtcttgagcttcagggcctcgtcttcatcgaggaggacttcgttcggatcgacgggcggcgggaagagcccgagctgcacgttgtgctcggcggcgcgctccgtggcggcgcccctcttgtggaggttggtggggtggaggctcgcgttaccggtggccgcgtcgccgaccatcgtgccgatggcgagcgtcttccccgggttgcagacgagttcgaggtggtcgtggagaagtcgtttccacccctcgtggcggatgtgcgcttcccgcagcatccgcacgtgctcctggtaggcacgcgtcccgccagtgttcgcggggtggttgggggtggccgttcgccgcgccgcctcgccggcatacagagccgggtgcagatactccaacttcgttcccagcgacgccagctgggcatggacgccttgggacacggagcctccgatgattggacgggaagttataaggagactaccgcaatcgaggcgtcagttttataagtttgccctccacgaaccttaaggtgatgcatagttgccgccccccgaatgttgccgacacaagcacggcttcagagcacgccgcagcccgctcgctcgccagcccgacgaaggaaccccgtgactcagcagaccaacggcccctccccggccctcaaggcggcgttcgactcgatgaccctgctggtcgcggcggtcatcgtccacgaccgggccgccaatcgcgtcgtactcctccagcgcggcgagaacgccaagttcggcaggggcttgtgggatctgcccggcggcaagagcgagccgggtgaacccatcaccgaaagcgcagtccgcgagctccatgaggagaccggcctcacggtggaggccgactcgctggaggtcgttcacgtcatccacggcgcctggggcgtcgaggctcccaacggttacctcacggtcgtcttcgccactcacgagtggaccggcgagcccgagaaccgcgagccccacaagcactcccaggtccactgggcccacgtcgatgacctgcccggcgaattcgtccacacgtcgggcagtgccctactagccttcctgcacggcggcccgcaggtcacgctcagagggtggtcgtagaccccgaaggcaggagagagtcatgtccgattcgccttgggacgccgctctgtcgcccatccagccgttccaccccttcaacgacgtcggcgagccggtcggtctgcaccgcgggcaggtcagcggtgtgcgggatacagaggtgcccggtgaggtgagccttgcgtgttcaccggttctcagcctcgactggagcgtcgcccccgagccgaactcgcatccgtacgcgcaggacacatccgtcctgcggcttcctcggccgtacggtgaggcagaggtggaagcctgggtccgcgatttcgacgaaggctggatcaacggagccgtcctgggagacagcaaggcccctctggcacggatcgcggtccactggttcaacctcccccggttcaccgggcagcatcacctgaccgaccggatcgagggtgcggatcggtactggtccgggggccgctggtcccacgaggtcgacggctggaagatcgtgctggacgtacgccctgaccaccgcgctgtctgggaaggactcctcaagacccggctctacgcgatgacgcatgtgatggagatcagccgtgcggacggacggcgattcaccgccagtgaggccacgcaccttctcacagccctgcacctcggcatgtcgttctcgcttggccgctggaccgctccgctcctccctgtcggcctcggggctgacgggcaggccgtctgggagtcctggggtgccctgcactgcgatccggcgcggaggcactcctccggctggtgggactcgtgggacatcgaagccctcggcaggttccttgacgggctcgtcccggtgatggccgatcccgtgatcgcggaaccgctgaagccgcagatcagctacgcgatcacggccatgcgtgaccagggattcgtggagcagcgcgtgatgatcgccgctgccggactggagcacgccatgtggcagcgtctgttcgtccgtggtgttctcacccgcgcggagtacaagaacacccgcctgtggcctgcccacgcgaagctgcggaaggttctcggggaaatcaacgtcgcagtctccatcgaccgcaaccatctgcccgcgatggccgccttcgccgacgagatgcgccgacggaccggacaggtctgggacgggccctccgtggtgacgaagatccgcaactacatggtccacccggaggaggaccagagggagctctaccggatacccggcctcgtcacggaggtgtgggtacttgcccgccactacctgtccctgctggtcctcgagtcactgggctatcgcggaccgcatcagaacctgtcgaagatccgcggcatggcaggcgaggtcgaggagactctctggccctgactcgggcatacccgacatctcttccgagtcgcgcaacgaagtccgcgactcgggtcagtgcctccgccaggcgggccggcgggaccgtgcaggagatacggacgtggttgggggccgcgaagtcggcgcctgggacgaccgcgacgttggcctccgcgaggaggagttccgcgaagacctcggccgaggtgatggtctggcccgccagggtgcggccgtaggtgcccgagatgtcggcgaggaggaagaacgcgccggtcgggtcgccgtcgacgtcgatgcccgggatgtccgcgagcgccttgatggtggtcaggcggcggtcgtccagttccagtcgccggcgttccagctcggtggtgaggtcggcggtcagggcgccgagggctgccttctgggagatggaggagggcgcggaggcggcgtggctctggatcccgtgatggcctgggccaccgagggtcgcgcgcggtgatgaccgcgggctccgtcctcggcaccctcgcactcctcgtgatcgcgaccgccaccaacctggccgtcttcacactgggttgggtgctcgccggcttgaccatggccgccaccttctacccgcccgccttcgccgccctcacccgctggtggggcccggaccgcatccgcgccctgaccatcgtcaccctcgtcggcggcctcgcctccaccgtcttcgcaccgctcacggcagtcatcgcggagcacctgagctggcgcgccacgtacgccgtcctcgcggcgatcctcgccgccgtcacgatccccgcccacgccctggccctgcgcgccccctggccggccgccccaccgcaagctcccaccactgacggcaccacacccataccccgcagccgccccttcatcctgctggccgtggccttcaccctctcgggcttcggcatgtacgccgtcgtgatgggcctcatcccgctcctcaccgaacgaggagccacagccacgcaagccgcctgggctctggggctcggcggggcaggccagaccctcggccgcaccctctactcggccctcgcgacccgcacctcggtcacggcccgcaccgccaccctgatcgccctcgcgatcctcgccggagtcgtccgcggcaacctcacgctcctacaggccaccgcggtcaccgaccgctggggcaccacgcactacggccgcctctcagggcttctcggcgcacccacccacatcgccgcagccctcgctccctgggccggagccgccttcgccacgcagttcggcgggtactccccgctcttcgcagccctagtcgccacttcgttgctcgcgacggtgctcgccgtggcatcagcggcgaggaagccccacccggtcagttccgccgatccgaggtgagcgtgatccagccgtccgggatccagccttcgaggtagccctccaggaacggctcgaactccgggattccgaggtgtgccacttccccgagcgcctggcgccacggaagccacaactgtgatggcccggggccgccttcgacgtgcatcgtgaacagacgtgccttccgatgtgcgccgtcaccgggcgacacgccatccagccgggccaccgtgccgccgaaccggaaagccaagccggcagcgagtcggcatgcagccgctctgtacgactcacccggggcacacgcgcccatggggaggctcatgagccccggcgagtactggacaaggcccatccggtgaaggtcgtcgaagcacactagatacaccacacgccgccgcacctctggtgcatacatacccacaagaaaaagaatggcccgtcgggagcgcgacgcactccgggcggaccgaacgggtgggtagtcggcgatctcaggactcgggcggcgcgggcggcagcgccgccgggccgggccagatctggaaaccgaaggacgcttccaagcgggcgagcgtgcccgagtccggcataaccctgccgttgagcaccctgctgatcgtcgaatgggtcaggccggtcgctgccgcgaggctgcgcagcgtatgtccggtggaggacatggcccgcgcgaggttccgggagagggactggccgtagtaggcactgaccggagcatcaggagcgagagcggcattgggccaagcgccgtccacgacgtagtcgcgcggctgcttgtcgttgctgctccggggcatgccgagatcatcccacgtacccatggggccgacccttcccttgtctcggatcccgcaacggagacctcttgtgtgttgcaagtacggaacggcgtaagggtccacgagccgtccgtgcggcacattccagggtttcggcagcgctccgtggtggcgggcgacgacaccacccggtccctcacgcgccactcggctactacgcgcgcccgatgcgccactccggcaagcgttctcagatgcaccgagaccggagacatcatgcaagtcataagagacatggcctccaacacgactcacttacagcggagttgcacccaaccccagagaatctgcacgctcgcatctatgcatttgcctgcggagcgggcgagggctcgctagcttgtgggtggatcatccgaggggagcggagcatgaccacaacaggagcggggtccgcgcaccctctcgttgaacaccttcgcgagatccaggccggggaacacgccaaatgggtcatcgcgactggcgtgttggccgaggtgcgacaagagatggccgacctccaacgtcgcttcgaagaagcggagcgatccctcctggcggccgacgtacgactgtcggccgtgagcgacacggttcgccaggccgaggagttcttgggggcgaagcagccctcacatccaccgacggatccaggtgaacgcccgaatcccgcggacccgcagagctccggctccgacgcccgcgactccggtgtgccacatcaggcggcggggcggccggcctccggcgtcgacacggagcagaagtccctcacagagctggtcctcgaagcgctcgcggacggcctggatacaccgacctccaagatcgtcgcccatgcccagctggagcgtccggacgcgacacctcggcagatcaccaactgcgccagccacatgcgggccaaggggaaggtcctcattgtcggccgcggactctaccgactggtcagcaaggagccgcgcacgtagagatcgccatcttccaaacagaaaaaggcgccgcctgggtgggaagaccctggcgacgccgtgacacgtcagctgagggcccacgcgccgcctccaggctaggccatggagtagcggcccacccggccctcgggaattttgtgcatttagcacttgatcataaatgagggcccacgccatgccatctgacgcattcatgcaccactggcccctacaggccagcagcagtcaggcgctccagtacccccacgggggtgttcgatgagtgccgcagacaaagtccgcatcatcatgcccaccggcggaatggccaccctgcggcagctgaaggtggtcgacgccgtcgccgaactgggcggcgacgaccgcctggccatcccggtctcagagatcgccaccaaggtggggctcagcgcctccaacatctcctcctcgcagggctttcttcgtcaagccggcctgctggagacgcaccacggagccctttcggtcaccgatgccggctttcagttgacgcggctccgggcggaggactccgcccgcgctcgcctcttcctgcatgaccactggcagtccgcctggttcaccaaggccgccaagcgcctcctgcgacaagggccgcggcagaggaccacgctcgccgaagagctcggccaagggctgcccgcagcggcgcccgaacgcgggctctatctggtggactggctcgactacgccctgatcgtccacgtcgccaaggacggactggtccgcctcccgggctccatccccacacccccgccccccgccgctccggcatcaggcctgttcctcagctccgtcgaagagaccatggcgctacccgacgacaccttcgtagcggccatgcgggcttacgggaccctcgtgagctcgctccgagggccggcggcccgcgcctagccaggccggctcgccccgccgcaccgagtgacgccccgggccgtcctgcccggggtctcttcggcgcgtcctcatccattcgcccacgccgggttgcagcggagatcacacatgcccaccgtaatggtgcaagtacggaacacaatgaatcattcgaatcttcccagtcagagggtcgggggaggggtcgaactgctctccccgaccctccggaggaccgtcatcatgggaagcgacctgtctctcatccatgccatcgacctcgtcatcgacgcatggcgggagatgaccgccctcgacgagatgtccgagcagaccttcgacaagttcggtctcctcatcaagaggttcggacggaacgccactgcgcgaggcgtactgctcatctcggacgtcaccgatggcatcgccgaggacttcgtgaacgccaagggccggagccgccacggccacgtctcggactcggcggtggctacccgccgagtccgccgaagcgtcttgcgaaccgccttccgcaccctgcacgagctcggcctgagcgaccaggatccgacacgcaacatcgtcctgcccgcccgcacctacgaaggttcccgtcctctcaccgaagacgaggccgtactgctgcgccaccacgccgcatacgcggcccggccgacccggcacgcagccgcggccgccctcgccctggctggcgggcacagcggcgagatcgggcacagcgtcgtggccgacctcgacctgccgcacagccgcgtctggatgcacggagcgcgcaagtacgacccccgctggtgccggctggacgcctggagccgccacgtactggccgatcgagctcgccacgtcctcgctcagcacccggacaagagcaccgcgcgcctcgcggtgtcctgtaccccggcacccgatccggccctgcaatcgcgcacgtgtgtcgcgctccgcgatctgctgcgcaggatcggtcttgacggggaacccgacgtcaccccggcttccgtcaccacccgtgccgccgtcgagaccttcgaagtgaccggccgcatcgaggaatccgcccgaaggctcgggatccgatccctggacagggccgcctccatcgtcggctatgactggcagaccgaccccgcctacaccgacgggggtccggcccgtgcctgacgacgtcttcggaacccccaagccccagcccgaacgcccgcaccgcaaacgccagctgaccgaccaagaccagcgcagcatcgcggagcgcgtccgcgactgcctcgactacccgctcctctacgagatggcggaactcctgccccctccgaacgtcgtcggctgcccccgcgagtacccgggcatcgtctacctgatcatggccgccctcaccccggtgacgaagtccaagcgttccaccacaggactcctcgcctctccccaggactggcgcagcgtacgggcgagcatccgccgccacctgggccgcagggcagcggcagccctgcccctctccgcgccttcccgtgggcagtaccaggacgccctgaacaaccttcttgtaccggccgccgacgcactcgaggaagcgttccgcaggtatgccgcccagcaagccctgagccaggggctgttcccctcggacgcacccaaggtatggagtcgccccgaacgccgacagctccttgtcggcgacgccaccgtccccaaggcaccctccaaagcgcgcgccgtggagatcgcggacgaggacaccggcctgatccgaaaccaccgcgtcgacccggccgcccgcatctactacgagaacggagagaaggagaagcggcgggtacgcggcaccaagtggttcttcgcctccggacgcgacaccggctactggacccgtgtcatcctcagcttcgcccacgtcgccggcggcgagtacgaagacgaagcggccatcgccgtacgccagttccgcatgctgaaggacgcactgccccagtgcatgggcgtcgtctacgacggagccttccgcggtgtccaccgcgacgccctcgcccggaccggcctattggccatcaacaagcagcacggatccgtcgcccccgtcttctacgaacgcatcagcccctgccgaagcggccacgagctctggtgcgaccaaggccgcatcgccgagagcatccgcatcgacgacggcacccgcatcctcgaacccctccccatcaccaaactcgagcaccgtgccggagccgccaagagccgctggtaccacgtcctcaagatcccctgccgccacggcgaccacgactaccgcgtccccgtcggcatcaccaccacccccgccgaccggtcactgcgctccgcagacaccggcaagcgcatcaagagcgacagtgaacgcggcttccaccgagccgaatacctccagcagatccccgaggccagcctcacccaccaactcctctacccctaccgcgccgactccgagtccgtacacagccaattcgaccagagcctctggaaccgccgcatgatcgcctacggcgtggatcgccagaagatcttcgtcctcggcttcgccctctcccagaacgccaccagccaccagatccaccttcaagcccgcagcaacgcccaacaggtcctccgcatcgcctgacacccctcgaccccacgacggccgcgcccaccccagggcgcggccgtcgctccgttaaggccccatccatggcaagcggaacagaacggacgctccagcagcctgcccacacccgtgcagcacccccggcctccccacccaccaccccagacgctcagaaaccccaggtcacgacgatgccttcacctcaggcccactcccacggcaatccatgcgaccactcccagcacgatccgctaggctgtcagcggtcagacgactaccaggcgtgtgccggggaaagtgtccgcgagggcagctccacccgggcgggcgcacgtcatctgaccagcacgcttgccgaagcggctcgggtgatccctctggggtttccggcagcgtttccgacaagcccccgccttcgtagctcaggggatagagcacggctctcctaaagccggtgtcgcaggttcgaatcctgccgagggcacggacgaggccccgcggtcgatatcgatcgcggggcctcttcgcgttgtggttacatggcgtacgtgtcgcgtgacgccgcctactgagatgtgggccgggcggtggttgggcaggcacctgttggtgaaggaccgggcccatgggcatgtatgccaccggctacgggtgatctccctcggttgttttcgctgccgtcgcacgcacgcacaccgtgagggatacaacactccatgtcatcgttcaatcacaccgtcatcgaagagttcagggcgaacgccggccaggtcggcgggcccttcgcgggttccgagctgatcctgctcaccaccaccggcgccaggtccgggaagccgcacaccgtcccgctcgggttcgtccgcggggacggcggcggggagttgctcgtcgtcgggtccgccgccggggccgaccggcatcccgcctggtaccacaacctgctcgcgcgtcccctcgtacaggtcgagaccggggccgaggagtacgaggccgtcgccgtccccgccgaaggggctcggcgggacgagctgttcgcgaggatcgtccgcgcggagcccgggtacggggagtaccaggcgggcacccgccgggtgatccccgtcgtcgcgctgctccgcacgcacggggccccgtcccgggagggcgggatcgccgggaagctgctcggcgtgcacggctggctgcgggcgcagctggccctcgtacgggacctcgcgcgcgcggagccgcagggcgccggggcggcctcgctcgggctgcaactgcgccagcactgcctcgcgttctgccattcgctggagttccaccaccggagcgaggacgccggcctcttcccgtacctggagcagcggcatccccccatgcgggagttcttccgccggatcggcgccgagcacgccacgatcgcccgcctccaggcggagctggtacgcgcgctggacgcgcccggtgccggattcagcgagcgggtggaacggatgagccgggagctggaggctcatctcgacggcgaggaggcgcagttgctgccggtgctgcgggccctggaagcgtgacgcgagcctcggcgccgcccgcctgccggttgcggaaggtgagggtggcgccgaggacgcgggcctggccggcggcgatggtcaggcccagcccgtggcccttgttcgtgccctccgtacggaaccgctgcgggccggtggtcagcaggtactccggatagccggggcccgagtccgtcacggtcagggtccggccgtcgaccgtgagcgtgacgggggcctcgccgtgactgtgcgcgttggccacgaggttgcccaggatccgctccagacgccgccggtccgtgtccacccgcagggcgccgcgcgggccgcccacctccagggccgtgtcggtacccgaggcgcggatcgtgcgcgccgccaggtcggccaggtcgtgcgagtccagttccaggcgttcgccgcgcgtctccagccgggagatctccagcaggtcctcggtcagcgagcgcatcgcccggacccggtcccgtacgagctcggccgggcggcccggcggcaggagctcggcggccgcgttcaggccggtcagcggggtgcgcagctcgtgggcgacgtccgccgtgaaccgctgctccgcttcgagcttgccctggagcgacgaggccatggtgtccagggcccgggagaccgccgccacctcgtcctggctgcgcgtgctgtcggcgacccgcgcgtccaggtccccgctgctgatccggcgtgccacctgcgcggtcaggtgcagccgccgggtgatccgggtgacgacgaacgcgccgatgaggagggtgccgccgatggcgagcgcggaggagccgaggatggcccggtccagttcggcgatggtccgctcgctcgcgcggaagtccacggagacggctatcgcgctgccgtgcgcggcgggcccggcggcccacatcacgggccggccccggtagcggccgactgccgtaccgcgcctgccgccgacggccagggcgcgcagctccggcggcagtcccgcggggtcgatgccctcgccgcgcggcatgcgtgcgccggtctcgtaggcctcgatgctccgttccagccggatcagcgccttctcgcgggccgctcccacggtctggtgggtcatggcgccgtgcacgaggcagcccagcagcgccgcgagtccgcagcacatgagggtgatgaagaccgtggccttccaggtcagggtggaggtccaggcgggcagccgcgggcgcggcggcagccgctcgtcgcgctgcgtgtcgttcatggtcacgtcacggtaatgggcgatccccggcgggtgaccggcgggatccggccggatcgcaccggatccgaccggatcaggccggaatcaggccagatcgcggcggatgcaaggcccgccacggagcggatgcggcgcacggagcacacgaagcgcacggagcggatgcagcgcacgaagcccttccggctcgggccggaagggctgtgccatcacggtcagctcaggccactgctgcgttcgccgatacggtcgccctgcggagtgccggcccgcttgagggcggccttcgtgtgcgatccgcccttgaccttgctccgtaccggaccgctgaagccgtgtcccggaccgcgcggcggttgcgccgtctcctgcgccttcgcgatggccgcccggacatcccgcttctgctctttgttcatcccgtcgtcaactccttcgggaagcacccaatcggactactcggatcgtatgcacatatacggacccacgcacccggaccggtgtgcaaagaattccgatcaagggcgtcggccgagagcctcgatcagggacgcggcggggccggacgcttcggctggcccagcgtctggtgcaccaggtcctccgggcagggcgtcccccgcggcagctggtacttcgccgccacccggtactgccccggcgccggcgccagcagctccgtccacacgtccccggtgtcgtccggagcggccttgaagaggcatcccgccgtgttcgcgtactgcttgcgcagtgcgccgccctccccgctcccgccccgcgccttcgaggcgaaggtctcctgcggcggcggtaccgccttgcccgccgcgtccacgagccccagccacggcgagtgcgggatccgtacgaggacccgcccgggctgcttcacgtcgacgaccagctggtcggcgctcgcccgcaccacggtcgccggcccggccaccaggtcggtgggctgctcgaccttgaagagctgccagttcgcgtcgccccacacctgctggaggtacgggagcccgccgcgcaccagcttggcctcgtcctcaccgcccgagtcgggtttgtcggcgggcagcaccacgtagtgcacggcccagcgctccagccaggcccggtagctgtcggcgccgagggtgtcgtcgtagaagagcgggttgcgctccaggtcggcctgccggttccagccgcgcgcgaggttcacgtacgaggggaaggcggaggactcgcggtggctgctggcggggaccacctcgacccggccgcggtcggcgcccgccttctgcagctggtcgacgagcggggccagctcccggctccaggcggccagcggggtggtgcggacgatgtcggtgacgctgttcgtagtgatccaggcgttcagtccgacgaaggccagcagcaccgcgtaccagcgccgcgagcgcgggagctcgtacgggagggccgcgagcagcgcgaccccgccgaacagcatgaccatgcgggtgacgttcgagccgacctgggagtcgatcacccaggtcaggaagaccccgagggagtagaccgccgaggcgatccggacggtcttccaccgcctcggtacgaggaagacgatcagcagcccgaacacgaacgggagcccggccgagccgatcttcatcggctgcgtcccggagaacgggaacagccacgccgacagcccgaccacggccaccggggccagccccagcgcgtacgcgcccgggcgccgccggctcaggaacagcgcggccgcgatcaccccgaggaagagcccggcgacggggctggcggcggtcgcgagaccggccagcggggccgccaccgcggccttggcccagcgccgctccgcccatttgcggggccagcagaagacggcggcgacggcgcccagcgcgaacatcacgccgaggccgaaggtgacgcggcccgagagtgcgttgcagaacaacccgtagaccccggccagggcgggccacaggggttcgcgcacggcaccgcggcagcgggtgaggatcagagcgagcagcccggccgagacggtaccggcgaccatcatcgtggtccggacgccgagcatgtgcatgaggtacggcgagaccacgctgtacgagacggggtgcatgcccccgtaccaggcgaggttgtacgcggagtcgggatgacggccgacgaactcggcccaggcgtcttgcgctgcgaggtcaccgccgctgttggcgaagcagaagaaccagacgacgtgcagcagcgcggcgaggacggtggcgacgatcaccggacggcgccgggccccgtcgagaacggcccccagcgggccgcggggcggccgtatgcctccgggcacgggcacggagagcccgccggaccccccggacccggcggacccggcggacccggcggacccggcgaccacggtgggcgcgtcgaccacggtgggcgcgtcggccgacgggatggcctcctggcgccggccctgctgctcagcggtggtcactgccgcactccccaacccatgagtccacgaacttcccgggagccaagacgtggcccggcgccccggggttgcccggggcgccggatccacgctctcaccggatgtcagccgacgcgcgtcagcttgctgccgatgcccggcgcggccagttcggtcttgagcgccaccggcaccttgacctggctggcaccctcgccgacggtcagcaggccgacctcggtcccggccttcgcggtctgcggcagcttgccgccgccgtccgcgagcttgatggacacggtcagcgaggcccagccgaccgcctgcacgtcggcggtggccacgaccggcgtgcggccgccgagcccgtcgtcgacgtagcccacgacgtcgcccttcttcacgacggtcgctccgtcgagggacttctgggtggcgaccatcagctccttgctcgcggcgagcacggtgtcgatgatcgacggcttgtgctggccgaggacggctccgacgatcagctggttggtgttgccgaccttcttctgcgcggcgaagagcaggtttccgcccgccttggtcgtcgtaccggtcttgatgccgagcgcgccggcgggtccggtgaggccgttccagttgcgccagctcttgccggacgggtcgacccagttcggcttcttggtgatgtcgagcagcgtctcgatctcgaccagcttcaggcccagcttcacctggtcctcggcggtgctgaccgtggtcgcgtccaggcccgaggggtccgtgtacgtcgtgttggtcatgccgagttccttggcggtgtcgttcatcttcttgacgaacgcctcctgcgacccggagtcccagcgcgcgagcagccgcgcgatgttgttggccgacgggatcatcagggcggcgatcgcgtcgtactccgtgatcttgtcgccctccttgaccgtgtcgagggtggactcgttgtcggtcgagttgttcttcttgccctcggtctcggccgtcttgtcgacctcgatcatctggccctgctcacccttcttgatggggtggtcgcgcaggatgatgtacgccgtcatcgacttggtgacgctcgcgatcggcacgggcttctgctcgccggactggccgagcgtgccgagaccggcggccgccatgtacgcctgcccctcggtgggccacggcagctggggcttggcgccctcgaaggtgtacgaggacttcgcggtcatgacgagcttcggctcgggcagcgggcgcaccagctgcaccacggccaggatgaccgccaggagcacgacgagcggcgcgtagatcttgacccgccggatggcggtgcgcatcgggctcggcggcgggggcgggttgttggtgaggtccgccagcatgtcgagcggcggcttgggcggcagcggctgctgcgtggtccgctcggagtggtcgaaccgcgcggcggcgggcggaaccggaaccttgggccgctgcccggcggcgggcttcggcgcgggcgcggtcgcgggagcgatgccctccggacgcagcggcacgaaggtgctgcccttgggcgactcggcgtcgggcttgacgtcggcgggcttcgcgccggtcggcttggcctcggcgggcttggcctcggccggcttggcggcgagcctggcctcggcgggcttggccaggttcggcctggcgggggcgggcttggcgggggccggcttcggggcctgcgccccggcggcggcgtccgccttcgggacacggaagacggcggtgcgctcgctgtccgcgggctcttcggccttcggcttctcggccgcgggggccggcttcggttcctgcttcggttcctgctccggctccggcttcggcttcgcggcgggcgccgaggcggaagcggaagcggaagcgggcttcacggcgcggaacaccgcggtgcgctcgctgtccgccgactcatcggccttcggcttctcggccgcaggctccggccgctccgccgcgggagtcgaaacggaatccgtcttgaaggcacggaacacggcagtgcgctcactgtccgcgggcccttcgaccttcggcttctcggccgcgggcttgggcgtggcaggcgtgaaggcgcggaacaccgcggtgcgctcactgtcggcgggcttttcggcctcgggcttctcggccgcgggcttcgcctcgacgaccggagcgggggcagcggaggattcagaaacggaatccgagctggagtcggaatcggggtccggagcctcggtacgggcatccggtgcgccggactcggcggcgtcgggctcggcggcgtcgggctcggcggcgtcgggctcgtccgcgcccgcctcgtcgtccaccgaagcggaatcttcggcttcgctcgcagcggcatcgtcatcggcgccgtcggcggaggcgacccacgccgccaccgcgtcccgcagcggatcccgcccgccggctccggcctcgggctcggctccggcctcggcctcgactccggactcagctcgggcttcggcctcgactccagactcgggctcggccccggcctcggacttggcctcggctccggactcggctcgggcatcgacctgaacatcgacaccggcactggcaccggcactggcaccggcggccaccgccgcgccgttctcggggtcccggggccggaacaccgacagcctcggatcacgctccgcggacgactccgccgcccccggcgctccttcatctaccgacttgtcgggggactcgcccgccaccgttcctcctccatcgccgccacgtccggctgtccgaatgtctaacagtgtcccgtctcgggagcatcgcccccgtgcgagacgagaacgacatagctgcgggttcccccacaaagcggccacgcgctctcgacagatgaatgtgagaggcgtcaccctgtcactcatccacgcggggaggcatggatgggcaggagccgcagaacaattccggaggagcttctgctgctcgccttggacccggccacgggtaccacggcgcagccgcagtcgctcgacctcggcctggccggggcacagctagtggagctggctctggcaggacggatagcccctgatggggatcgtatcgccgtggtgatgccacggccgacaggagatccgactctggactccgcactggaactgctgcgcaggcgcggcagcccggtacgggccgtccactggatcggcggaccccggctggggctccgccagatttacctcgctcatctggagcgttgcggcatggtccatgccgtcgcgggacagatgtgcggagtgctgccgacgactcgctaccaagcgacggacacggagatcagccgggagatccgagcccggctcgacagtgcgatccgcaccggcgtaccgccggacccgcggaccgcggcgctcgccgcactggcccacgcggtcggactcggcaagcacctgtaccccggcaacgaggggcggtcgtccagatcccggctacgggacctgatccggcacgacccgatgggcggactcgtggcgcatgccgtgatggacgtccagaacggtgtggccgcacagccacgccgtgaccgcgcacccgcaccgccggcccgtgccacggcgagcagcgttccgctgcagccgcgccggacgggcgcgatggcccgcgcggccgcgcactgatccaccccgctccacccccgttccaccgttccacccgtttcaccgcaccaccatcgcaacgccaccgccccgaccgacgtccgcgaggacgcggtcggttcgggagccgccagcgcgcggggtggcggggccggttcgccggtcccgccaccccgcgcgtctgtgtttcgggccgttccccagcggcgccgcccgcttcggtggcagtctgctcaagaccagatacgcagagagaacagctgcaacgacagaagaaggcggaggtgccgttcacgtggcgtccaatgtcaatcccaccgtccgacgccgccgactgggcatggagttgcgcaagctccgcgaggacaagggcatgacggccgaacaggtcgccgagcgcctcctcgtctcccagtcgaagatcagcagactggagaacggccgccgctccatcagccagcgcgatgtccgtgacctctgcgacgtctacgaggtcgaggaccgccgcctcatcgactcgctcatgcagatggccaaggactcccgccagcagggctggtggcacgccttcggcgacatcccgtacagcgtctacatcggcctggagacggacgccgccagcctgcgcacgtacgagcccctggtgatcccggggctgctccagacgacggagtacgcccagtccctcgtccgcggcgcgtggccggagaccgccccggccgacgtcgacaagcgcgtccaggtccggatgcaccgccagaagcggctctccgagacggagaacaacaaccctgacctcggcccgctgcggctgtgggccgtgatcgacgaggcagcgctgcgccggcgcgtgggcgacgcccagttgatgatccggcagctcgaatacttgatagagcagtcggagcagccgcacgtcacggtgcaggtgatgcccttcgagctgggcgcgcaccccggcgtgaacggccagtacgcgatcctggagttcccggacgcgtccgattcgaccgtcgtctacatcgagggcgtgacgagcgacctgtacctggagaaggccaacgacgtccagaagtacagcgtgatgtacgagcacctgcgcgcgcaggccctcaacgtcgaccagacccgcgacttcatctcggggatcatcaaccaatatgcagacaagggcgcatagcggccggataccaccgatatccaccgtgtgcgcggcgagcgggccggtacggtacaccgtcactccccagccacagaaggcttgaatggaatatgccacccggtcgggtgaatggccccttcacccgtcaggagctgccggtagcgtcgatcacgtcggccggaacattggccgacgggacaccggaaccaccggaactactcgctcaccggagagaaacatggctattcgccagggcgccacggccaactggatcaagtcctcctactccgccaacggcgcctgcgtcgaggtcaagtcccctgtcatggaggccatcgccgtccgcgactcgaaggtgcaggacggaccgtccctcaccttcgcccccgactcctggacctcgttcgtcgccgacgtcaccgagggccggctgggacgcctcgcctgaacgtcacggcgcgtcccgaccgtcctcgccgtccctaccgttcggtctccgcgtccggcaccagcaccggcgggaccggctgccgcatcacccgcacagcgggcggcacccgcagaaccagcatcaccagcaccacctgcgtcacccgtgtcactgactggagccctctcgaccgacccgccgtcttggccgagggggctcggccatgcccggggcgccgaaggctccctcagcgcagctgatcgacgtaacggtcggtccccggcaccgtcgggatgaacggcgccaccagttccacccgccccagtcccgcctccgcgacctccgtgtccagcccctggaaacggtcccagcaggtccgggggtcgtcctggaggaaccacagcagcgtgaggcgggtgtccaccccctccacctgcttgacgtacgtcatccggtcaccgggcagcggagtggggcggaagaccgtcaccatcgcggccgggccgccgtgcagccgcttcggcagggcgcgcgagcgcagccactccagcaactcggcccgctgctcgggcccgtcggcgtcgacgacctggacgacgaggccctcgtacgggtggtccagggcatggaagtcccgcgggccggcggcgccgtcgcggtagacggtggcggcgtggtcctggaaggacgtgaagacgtgggtgcggtcctggtagacccggccgtcgcggttcagacgcttgttgatgccgacggtccacttcatgtgctcgtcgtagcgcccctgggtgacccagtacgtcgatatgtagcagcccgcggtgacgggctgggcgacggccgacttctcggggtagcgcagctcctgcagctcgcgggtggccacccagcggcggcccgcgtacatccagggcatggccatggcgccggcgtagtagtggtcgtcctcgtaccagcggttgtacgcgtactcgtggcccgggtgcggttccaccatggtgatcagcgcatggccggggcggactccgtaggggccgacggccgcgagctcggcgtagtcctcgacgcgggtgtcctgttgcgggtcctgctgcgggtcctgctctcctgtcgtcatgggaacggtctagctgatgcggcatcagatggggaggggtcggggggggcggggagcgccggcggccgggccaccggtccaccggtccaccccctgatatatacgtgccgtctacaacttccctcgctacgatgcgcgcacccgcctcctgaaggagctgcccgtgcccgccgccgcaaccaccacctccacccccgccgccgtcgcaccgccgcccgcgttcgccgcccgcgccacctccgtggagggctcccccgtgcgcgagatcctcgcgctgaccgaacgccccgggatcatctccctcgccggcggcctgccggcgcccgagctcttcgacaccgagggcctgcggaccgcgtacgaggccgccttctcggtgtccgcgcggcgcgcgctccagtactcgaccaccgagggcgcaccggaactccgcgaggccgtcgccgcccgggcgagcgcgcgcgggctgccgaccggcccggacgacgtagtcatcacctcgggctcgcagcaggccctcaccctcatcaccgccaccctggtcgaaccgggtgacgtggtgctggtcgagaaccccacctacctcgccgccctccagtgcttccggctggcgggagcgcgggtggtggccgtgccctgcgacgcggagggcatcctgccggacgcgctggcggacgtcgtcgcgcgcgagcggccgaagctgctgtacaccgttcccaccttccagaacccgacgggccgcaccctcccggccgcccgccgggcggcggtcgcggacacggcggcgcggctcgggctgtggctggtggaggacgacccgtacggggagctccgctacgagggctccgacgtcccgtggctcgccgcgcacccgggcgcggaggaccgtacggccctgctcggcagcttctcgaaggtcatggctcccggcctccggctgggctggctccgggcccccgcggcgctgcggcgtgcggcggtggtcgcgaagcaggcggcggacctccacacctcgacggtggaccagctggccgcggcgcactacctcgcggcggtggacctcgacgcgcacatagccgcggtccgtaccgcctaccgcgagcggcgcgacgccctgcagagtgccctgagccggaccctggaggcggactgcgagtggaacctgcccgcgggcggcatgttcacctgggtccgcctgccggaggaccacgacgcggcggacctcctgaggacggccgtgtcccacggcgtcgccttcgtcccgggcgcccccttctacgccaccgccccggacccccggacgctgcgcctctccttcacgacgcacaccccggccgagatcaccgagggcgtcggccggctgggcgcggcactggaggaatacgaggacaagcggctccgatgacgtggccggtggcggtagcggtagcgccgccgacgccaccgccctcagtgctgcagggcgaccttgagcagcacgatgagcaccccgaggaagaggttgatcgcgccggccagcatcatcatccggcgcgaggccccggcgcgggcggcggccacggtggcccagccgacctggccgaccagggcgaccacgagcgccagccacacgatgccctggtgccccaggccgaacagcggggcgaccagcgcggcgacggccggtgggaccgccgccttgatgatcgggcgctcctccctggccgtactgcgcaccacgccccagctcaggtggtgcgccatgcgcaccccgaagaggctggcgaagacgtgcgcggcccagaacaccacaccggtacccagcagcagcgcgacgagttccagccgcgggaagttgccgagcgtcccggcgccgaccaccacggaggcggcgagcagggaaccgtagacggcgccgctgtagtccccgcgcccggcctcccgctccggggcccgctccggggccggctccggggccggctccggggccggctccgggccgtccgagggcgctgtcacgcgaccttggcctgcgtggtgggccacttgagttcgatctccatctcgatctccccgtcaccgatctcgacctcgatctcggtacggagctcatcggggacgcgcagactcatcttcccggggccgagttccagttcggcgttgccgccgtggcgcagcgcctcggcgagggcggcgagctgatcggcggcctcgaggcgggaaagggaactcttctgctcaaacttgaggtccttcacggatgtctccaatccgctacgaacaccgggtaaggctcattgtgacgccgcaccggaggtcgggcatcccgggcttcaaccggccgcgccggcccccggccggttcagggccagagcgaggacctcgctccactgcatgggcggggcggcctccggggcccccgggcggagcctggggacccgtacgcgcagtgctccggggcggatggagcagatcacgggtgtgggcatggtgagcgcctcgccgtccacggcgacggcgacgcgctccgcggccgatccgatgacgacctcgcgggaggtgagcaggtgcaggcccgccgccctcgctccgcgcagggccacgtcggccgcctgggcggcgttgttcacccggatcccgacgactccgagcacgccgaggtcgagccgggacctgcgggcccccatcggttccggggacgagtacgggttgttgctgaccagcagcgcctgctgggcctccaaccgcgtcccgtcggtggccgcgtcgagagtggtgccggcgtagccgagcaggaggtccggcagtgcggccagggccgagtccgccttggcgtcccggtactccggccgctgcacgatctccgcgtagacgccgaaggaggcggtgttgacgaaggcgtggccgcccacgacccccaggtcgaccctgagctcctccccgtcggccagtgcgtccaggcagcgggcggggtcctcgcggtccagcccgaggtccatggcgaaatggttccgggtgcccgcggagatcacgaggaagggcaggtcgtactcggccgccacctcggccacgcgggcctgggtcccgtcgccgccggccaccccgagcaggtccgcgccctcggccaccgcctgccgggcgagagcggcgacgtccgtcacgacctccgggtccagcagcaccacccgggcgccgagggcctcgctcttctcgacgaggccgaaccggccgaccttcccgccgccggacttcggattcatgatcagcaccgggtgccggggcgcggcccgtgcgacggcccgcatgccgtcgggccgccgcgcggcgcgcagcgcggtacgcgcgcaggccacggcggccgcccagagcgcgatggcgaccagcgccgtgggccacaggtccgcctgggcgtagatgagcaggatggccaccggcgcgccgaccaccagcagggtgccgaccagccgtacgaccccgcgatgggacaccacccaccaggtccccatggccgtgagcgccgccccggccaccccgacgacgaggacgagcagccccccgacgatcccctcggcgaccagggtgagcgccgcgaacaccgcacagaccacggccagcagggcccaaggccgagcccgccgggacgcgccggaagtatgcgggagtgccatgccctcacgtcctcgcctcgtgccgtggatctccaccacgagggtgtggtcctctccgatcatcccccgaggagcatcggccgtcgacgcgacgcagccggggcgacgccacttaaggagagcgggagatttagttgctcatgcaacgaacgacctcgccatcgaccccgtgaggccaatggagcacccctcaaccaccagcactcttgcctccggcacccacatcgccgaccagggattcgacgcgcctggcgaaatgtgcgcgctaccgaacagtaaatttcgccgacctgccaagccgtgcaaaagtgagttcgatcaaggtgtacgggggctggggtggggggcgttgtggtggggttcgacgaggagtggagccgcctgcgggccgctgccgtccaggcagccgacggaccggcggtggctgatccggcggtagccgatccggcggtcgaagcacgagaggcggtactggagcggctggcggaattccgcagccaggtggttctggtgccgctggacgtacgagacggcctgtggacggccgaactcggggggctggactggatctgcgcgttctcggacgaggaggcgctggcccggttcgccgaggcgcgcggcgagggcgaccgggagtgggcgtaccggcgcgtggtcggtgcgcgcctgctcgacgagctggtgccggcgctggactttccgtgcggggtcgcgtggaacgccgcggggccggacgggctggcgttcccgccggttcgagggatcgtgccggatgccgcggcactcgacggggggatggccgcatgagcggggacgggtcggatctcgatgtctcgaagcaggcgttggcgctgatcgcgcagggaatcacggcgagcctggccgagttgaaggagctcgggtcggtgggcacggcgagcatgggcggcggcttcaccgagctggctctctcggggatggagaccgggcacgagagcctggcgtccactctgggcacgttctgcgagcgctggggctggggggtgcgctcgctggtgcagcaggggaacatgttcgccctgaacgtggggctgtcggccggcgcggtgtacgagcaggaccagtacatccagggcagcttcaaagtcgtggcgaacgcggcactcggcaacccgtacgccgaggagaaggacatcatcgccaaggactggggcgaggtcctctccgacaacccgatcacccagatcaagaacgcggactacgagccggaatccttcgcacacgcctcggagaacggcaacgaggcctggaagagcgcggtccgggacctgaacagttccgacatcctgctgtccaaccagatcatcgatgcggtcggactgcgggatgaggcggacgcactggtcgacggcacggtcggcccggcacccgaggcacagccgggcggtgcgggccgatgacggactggggcaggctggtcgacaagggtctcgacgcgatcgacgagaaggtcgattcagccaagaaggtcatcggccacggcgtcgacagggccaccgacgaggtgggcggcctcctcgatcgtgcgggcgcgcacggctgggcggacacggtcgaggacttcggcgacggactggcctcccggctcggcgcctcggtacccgaacagcagctcggcgagagcgagcaggccaacgagctgatccacggcaagtcgtcggcgctccgggagtcggccaagcatctggcggacttccgggcggcgttcgagcgggtcggccagggcatgaaggccctcgactcggaccagtggaaggggcaggcggccgacgccttccgcgcgaagttcgccctgcatcccaccgactggctgcgcgcctccgacgcatgcgagtcggcatgcgctgcgctcagccggtacgcggagacggtggaatgggctcagaagcaggcccagtcggccatcgacctgcacaaggccgcggtgaaggcgacgaaggaagcccacgacgcacacgttgccaaggaggacgcctacaaggcggcggcgcaggccggccgtgatcccggcccgatccctgtcgagggcgccgatccgggtgcagcagccctcaagcgggccaaggagatcctggaagaggcccgcaggcagcgcgacgaggcggccatgacggctgaacgcacgctcaaagcggccatggagcacgccccggctgagatgccggcgacggaccggctgatggcccagatcaccgactacgcgggctcggaggtgttcgagctcacccacgtcgtgggcggcgtggcgaagggcacggcgggaacgctgaacttcgcacgcagcgtgaaccccttcgacgtgttcaacctgacgcacccggccgacttccagcagaacctcaacatgacgctggccggtctcgtctccaccgcgtcccaccccgagcgcatccccggcccgatgatcgacagctatatggcggaccccagcgaattcaagggccgcatcctccccgatctcatcggcaccaagggcctgcccaccctccggaccgggctgcgattcgccgagaagacggcgagcaaggaagcggcgcggacggccgcgaaggccgaagccgaggccgccgcccgccgcaaggcgggcctgaagtgcgacggcgacccggtcgacgtggcgacgggccggatgatcctcccgcagaccgacctggtcctccccggcgcgctgccgctcgtcttcacccgcaccttcgagtcctcgtaccgcgcgggccgctggttcggcccgagctgggcgtccacggtcgaccagcgtctggagatcgacgaggaaggcgtgatcctcgtccgcgaggacggcagcctgctcgcctacccgcaccccgagcccggagtccccgtactccccggccacggtcagcggtggccgctcgtcctcgatgcggacggcggctacacggtcaccgaccccgagtccggacacgtccgccacttcacggacgagggcctcctcagccagctcgacgaccggggcggcgcctggatcacgttcgagtacgacgcgtcaggcaccccgaccgccctgtcccacagtggcggctacgaggtgcgcctcggctcgtcggaaggccgaataaccggcctcgccctcgccgacggcaccgaagtgctccgctacgcgtacacggatggccacctcacccacgtcaccaactcctcgggccgcccgctccgcttcggctacgacgaactcggccggatcacctcctggaccgacaccaacgaccgccacttcgactacgtctacgacgagcagcaccgctgcaccgcccagtccggcaccaacggccacctcgacgtccgcttcgcctacgaggacggctccaccacctacaccgactcccacggccacgagacccggtacctggtcgacgaccgcgcccggatcacggccgagatcgacccgacgggcgcgaccacccggttcacgcacgacgcgtacaaccgcctcctgacccgcaccgacgcgctcggccacacgacccgctacgtctacgacgagcagggccggctcaccacggtggtccgccccgacggccgtgaggtacgggccgagtacgacgcgctgggcctgccggtcacggtgatccagcctgacggccgggtcacgcgggcgacgtacgacgagcgcggcaaccgcacctccgccaccgcggcgcacggggccacgaaccgcttcacgtacgacgcccgcggccacctggcctcggtgacggacgtcctgggcgcggtcacgacggtccgctgcgacccggccggcctgcccatggagatcaccgacccgctgggcgccacgaccacatacacgcgcgaccccttcggccgcccggtcaccgtcaccgacgccctcggccacaccacccgcctcacgtggagcgtggagggccgcctgctccggcgggagaccgcggacggcggcacggagtcgtggacctacgacggcgagggcaactgcacctcccacaccgacccgatgggcgggctgacgctctccgagtacggggacttcgacctcctcacggcccgcacgggcccggacggcgtccgccactccttcacccacgacaccgagctgcgcctcacctcggtcaccaacccccagggcctgacctggacctacgcctacgaccccgccgggcgactggcctgcgagacggacttcgacggccgcacgctgagctacggctacgacgccgcaggccgcctggtctcccgtacgaacgccgtcggcgccacgaccacgtacgcgcacggtgccctctcccagctcctgcacaaggagacggcggacggcatcacgtcgtacgagtacgacgacttcgacgagctcgcgcgggcggtctcgccggacggcaccacgctgaccctgcaacgggacctgtacggccgcgtcgtctcggagacggtcgacggacgcaccctcacccgcacctacgacgtcgcgggccgccgggccggccgcaccacacccggcggggccttctccgagtggacgtacgacgcggcgggccggcgcagcgccctcagcgcctcgggccgcacgctgacgttcgagcgggacgccacgggccgggagctgacccgcaccatcggcccggacctggccctggcgcacgcctacgacccggtgggacgtctcaccgaccagcacctcgtcggccaggacggccgcaccctccagcgccgcggctacagctaccgcgcggacggcgccctcacggcgatcgacgacgcgctcgccggtccccgcaccttcaccctggacccggcagcccgggtcacggcggtcgacgcgtccgactggaccgagcgctacgcctacgacgacgccggcaaccagaccagcgcctcctggccgtcccgccacccgggcgcggaggctcagggcgcgcgtgattacgagggcactcgcatcacccgcgccggctcgatccgctacgaacacgacgccctcggccgggtcaccctccgccagaagacccgcctctcccgcaagccggacacctgggcctacgcatgggacgcggaagaccgcctcgtcggggtcaccaccccggacggcacgcgctggcgctaccgctacgacgccctgtcccgccgcacggccaagcagcgcctggcgcccaccggcgaggtcgtggaagaggtcctcttcacgtgggacggcaccaccctctgcgagcagacgcaaggcccggtcaccctcacctggacccaccacggcctgcacccgctcacccaggcggagagcgtcctcggcaccacggacgaccgcttcttcgccatcgtcaccgacctcatcggcactccgcgcgaactgatcgacgagtcgggcgagatcgcctggcgcgcccgctcgaccctctggggctccaccacctggacccgcgacgccgtggcctacacgccactgcgcttcccgggccagtactttgaccccgaatcgggcctccaccacaactacttccgcacgtacgaccccgaaacggcccgctacctcaccccggaccccctgggcctggccccggccccgaacccggcgacgtacgtccacaaccctcacacgtggtcggatccgttgggcttgacaccgtgccccgagctcgggctcagcgaagcagctcagcgcgcgatcgaaaagctcgaaaacatcaagccggaccccataggagaaataaactcccagccgaatcacaatcactacgacgccgcacgaagagaagccgccggggaagtcgtagcgagaaagaaggacggaaccccgttcgatcacatacaggacctgtcccaggccagaagcgcactcgacagcgtaaggcggacgctggagcgcgagatttccaaccccccagacaccctaaccgaacgcgggctcgaagtgttgatcaacaagcggaaggaaaccattcgaatgctggaccgactcaatggattcctccattcaatcggccacagatagcccccgaccacacacgaaggctgcagatgaagaaaacccaagaacgcaaccgaaccatcgaggaactcgaaggggatagctggccggagccgccgaccgagtcaacgagcctggtcaaggccatccaccggttgcggaagcgtccgatcggcgagttgacggcgtatgaactcggacgcctcatcgggcaggacgtcgggcttcgatggacacttccactggcagtcgagattctccatgacagcgcaccgtcccagagcgaaggagggttctacgacgatgacctattgtcggcagtactcacccgaagagcagagacctgggccgaccaccccgacctcgcgagagaaatgcgggaggtcttgagtctgctggccgacatttctccgtacattgaacgcgaccgagcgcaatttctgaagaattccacagagtgatccgacgcccatgagggaaaccgcgtgccgcctcgtcggggcgcgccatggcccatgccgtcgccgcggtgcaccgggccgcggggaccgggcaggcgctggccggtcgtctgtaccgcagcagcaacccgcacgtgcgggcgcttctcgccgaggcaccccgggggatggcacatgtccggcgagccgccgtggggcgttcgcggtcggtgaccgcggtggcccgtcgcccttccgcgcctcgggcgcacacccggtcggcgcggccgggaccggcggcggcctccgcccccgccactcttcggatccgcaccccttcacaccgccccgcccgcgccgtagcctgacgcaccgtcagatatcccgtgtgcccggaggtccgtcatgctgctgcaagggaagaccgtcatcgtctccggggtcggggccgggctcgggcaccaggtggccgccaccgtcgtgcgcgacggcgggaacgccgtgctcggagcgcggaccgaggcgaatctcgccaaatccgccgccgagatcgaccccgacggagcgcacaccgcctaccgcgccaccgacatcaccgacgagacgcagtgcgcggccctcgccgagctcgcgctcacccgtttcggccggatcgacgccgtcgtccacgtcgccgcctgggactcctacttcgggggcctggaggacgccgacttcgggacctggcagcagatcatcgacgtcaatctgctggggacgctgaagatgacccgcgcgtgcgtgcccgcactcaaggagcgcggcgggtccgtggtgatcatcgggacgcagtcggccgtcgccgcgcccaacgaggtgcagcaggccgcctacgccgcctccaagggggcgctgacctccgccatgtactccatggcccgcgagctcggcccgcaccggatccgcgtcaacaccgtgctgcccgggtggatgtggggcccgcccgtgcaggccttcgtcaccttcaccgcccacaccgagggcgtccccgaggccgaggtgcacgcccgcctcacccagcggatggcgctgcccgatctggccaccgacggggacgtcgccgactccgtcgctttcctcgcctccgaccgggcccgggcggtaaccggccagtctctgctggtcaacgccggtgagctgatgcggtgacccgctccacgcccggatcaccggatcgtatgctcggcccatgaccactccgagtgacgcaccgaccgacaacgcgatgcgccgcgcgctccggcgggcccgcgacggcgtcgcgctcgacgcgaccgaggcggccgtactcctccgggcgcgcggcgaggccctcagggacctcgccgcctccgccgcacgggtaagggacgccgggctcgccgccgccgggcgccccggtgtcatcacgtactcccgcaaggtcttcatccccctcacccgcctctgccgcgacaggtgccactactgcaccttcgtcaccgtccccggaaagctgcgcaagagcgggcacgggatgtacctctcccccgacgaggtcctcgacatcgcccgccagggcgcggcgatgggctgcaaggaagccctcttcaccctgggcgaccgccccgaggaccgctggcccgaggcccgcgagtggctcgacgcgcacggctacgacgacaccctcgcctacgtgcgcgccatggcgatccgggtcctggaggagaccggcctgctgccgcacctcaaccccggcgtcctgtcctggtccgatctccagcgcctcaagcccgtcgcaccgtccatgggcatgatgctggagaccaccgccacccgcctgtggtccgagccgggcggtccccaccacggctcccccgacaaggacccggccgtccggctgcgggtgctggaggacgcgggccgctccaacgtccccttcaccaccggcgtcctcatcggtatcggcgagtcctacgaggagcgcgccgacgccttcttcgagctgcgccggatccagcgcgcctaccacggcatccaggaggtcatcgtccagaacttccgcgccaagccggacaccgccatgcgcggcatgccggacgcggagctggaggagctggccgccgccatcgccgtcgcccggcacatcctgggcccgagcgcccgcatccaggccccgccgaacctggtggacgccgagtacgcgctgctcatcggcgccggcatcgacgactggggcggggtctccccgctgacccccgaccacgtcaaccccgagcggccctggccgcacatcgaggagctggccacgcggaccgccgccgccggcttcgagctgcgcgaacgcctcaccatctatccggagttcctgcagcgcggcgagccctggctggacccgcgcctgctgccgcacgtccgggcgctggccgacccgcagtccgggctggccgacgagggcgccgccgtcgagggccggccgtggcaggagccggacgagggcttcaccgcgtacggacgcaccgacctgcacgccaccatcgacaccgagggccgcaccggcgaccgccgcgacgacttcgacgacgtgtacggggactgggaggcgctgcgggaggcggccgcgcccgggatggtcgccgagcgcatcgacaccgacgttcggggcgccctcgcgcaggccgccgacgatccgacgaagctgacggacgcccaggcgctggcgctgctgcacgcggacgggccggccctggacgcgctgtgccgcatcgccgacgacctgcgcaggtcggtcgtgggcgacgaggtcacgtacatcgtcacgcggaacatcaacttcaccaacgtctgctacaccggctgccgtttctgcgccttcgcgcagcgccgcacggacgccgacgcctacaccctctccctcgaccaggtcgccgaccgggccgcccaggcctgggacgtgggcgcggtcgaggtgtgcatgcagggcggcatccacccggacctgcccgggacggcctacttcgacatcgcgcgcgccgtgaagcagcgggtccccggcatgcacgtgcacgccttctcgccgatggaggtggtcaacggggcgacccgcacggggatgtccgtacgggactggctgacggcggccaaggaggcgggcctggactcgatccccggtacggcggcggagatcctggacgacgaggtccgctgggtgctcaccaagggcaagctgccgacggcggactggatcgatgtgatcaccaccgcgcacgagctcgggatccgctcctcgtccacgatgatgtacgggcacgtggaccagccgcggcactggctcggtcacttccgcaccctggcccggatccagcagcagaccggcggtttcacggagttcgtcacgctccccttcatccacaccaacgcgcccgtgtacctcgcgggcatcgcgcggccgggtccgacggtccgcgacaaccgggcggtgacggcgatggcccggatcctgctgcacccgcacatccccaacatccagacgagctgggtgaagctgggggcggagggcgcggccgagatgctccggtccggggcgaacgacctgggcgggacgctgatggaggagaccatctcgcgcatggccgggtcgagctacggctcgtacaagtcggtgcaggacctgatcgccgtggcggaggcggccggacggcccgcgaaggcccgtacgacgctgtacggggaggtgccgcgggagcggcaggacgcggcccgcgcctcggacgggcacctgccggagctgctgcccgtactggactgaacgcggacgcgcggacggaggggagccggtgacccggcttccctccgcggcggcgcgtgccgggtctcggccgacggggatcagccgacgaggaggtccttcttcagctccttcagttcgcgggcgtcgatgccgagcccgtccctgaggtagcggtcgaaggagccgtacttcgacgcgacctcgtcgtagcccgcgttcaggtactcgggacgcacgtcgagcagcggcttgtagacggcggcctgctgggcgggcaggcgggagaggatcgcgtcgttggcggccttgcggtagtcgttgctggccaggtagtcggcctcgacggtctcgcggggcacgccgagggcggtcagcagggtggcgcccgcccagccggtgcggtccttgcctgccgtgcagtggaagaggacggagcgggcgcggtcgcgctcgatgccttcgaagacctgggtgtacgccttcttgccgccggcgccggagaccatcgcccgctcggcgtcgaccatggccttgacggcctcgtcgggggtgcggggcatggtctggaaggaaccggagcccgcgaagacgtcggcgacgacgtaggcggcgcccgtgggcaccttgtcggcgtccttggtgcgctcgtcctccatgcggaggtcgaagaccgtcctgacgcgcaggcgctggagcttggcgaggtcgttcccggtcagcttgttcagggcgtcggagcggtagatctcgcccatcttgacccactggccggtgctggtgcggtagccgccggcgtcacggaagttggcggtgccgtccagcttgatcaggcggtcggcgaggcgcaggccctggccgtgcccgggcttgaagtcgaaccactggcggtcggcggcgggcaggcccgtgaccacggcgcggccctgggagccgcccttcgcgacgaccttgccgttcgccctgatctggacccggtcggtgccgcgggccttccactggagggtgaaggagccgtcggccccggcggtgacggtggcttcggtgaacgggacggcggaccggtcgtgccggtcccagccggtggcggaggcgagcggggccgcgaccagggagacggtgaccgcggaggcgacgagggtcgcggcgaggagggccttcttcatggctccgaggctgggcggccgcggagaacgtccgatgaacgaggcgtgaccgaaaacgaccggctcgaaggcgactggcaaaacgtgccacctgccgggtcgcggccggaagtgttcggattctggccgatctacgctcacttacgggacccgtggccgaccacttccggattcgaccgatcctgtccactacagtgcgggttcgcgtgcgcggcgggtacgggcagggacgccggcatcgagtgggctggtcagcggggggcgcggtgccgggaatggacgcagtgaacagcacgaaccacggttccggcagcccgcacaccgccccgcccgcccccggaccaccacccgcccccggccccggcccgatggtcgtcgtccccgccccgggcgcaggcccgcagggcgcaggccccgccggacccctgcacgtccacgccgccccggcgcccggccccggccccaaaccggtggacggtgccgcccttgcgggcgccgacccggcgggagggaccaccgccgcgggcgccggccacgcagacggacccgccgcctcaggtgccggcccggcaggaggaaccggcccgtcgggcgggaccgccaccgcgggtgccggccatgcggccggcgcctccgcggcagcccccgcgcccggccctggcccgcagggccacggcccgggcgagagccccgggggcgacgcgcccgccgcacccctgcacgtccacgccgcccccgccgcgcccccgcgcggccgcgccgccccgggcggtccgggccccgccggggcgaaccgcacgctcggccgcggcatcgccaccggcctctggggtcgcgtcgagcagcaggacttccgcagccgggtccgcggcaccctcctcggctcggccctcggcgacgccctcggcgcacccgccgccgacctctccctcaccgccctgcgcgaggcccacggaccggacggcctgaccggtccggcccccgccctcgggcgccgcggccgggtcaccgccgccacccagctctccctcttcaccgtggacgggctgatacgggcccacgtacgccgtgacaccggcgcctggcacccgcccaccgacatccaccgcgcctacctgcgctgggccgccacccagcacgactggggccccgacgagcgccgcaaggacaacggctggctcgcgcaggaggaatggctctacgcccgccgcgccccgcaccgcgcctgcctgaccggcttcgccgacgacgtcctcggcaccctcgaccagccgaagaaccccaccgcccgcgacgcggccgcggccacccgctcggcacccttcgggctgctggtcggctgggagcccaccctcgtcctccagctgtccgtcgaatgcgccgcgcagagccacggccatcccaccgcccacctgtcggccggggccgtcgccgtcatcgtccacggcctggtccgcggcgactccctcgactccgccgtccagcgcgccctgggcctgctgggctcccgccccgggcaccagcccgtcaccgacgccctgcagcgcgccctggccgccgtcacccagggctcgcccggccccgacgccgtcgaagccctcgcctgcgacggggcgggcgacggatccgacgccgccggcgccctcggcgccgccgtctactgcgccctggtcgccgaggacgtcccgcggggcctgcgcctcgccgtcaaccacggcggcgactccatcgccgccggcgccctgtgcggggccctgctcggcgccctgcacggcgagacggccctcccggccgcctggctcgccgagctcgaaggccgctccgcgctgctggaactcgccgacgacttcgccctggagatgacccagggcccgagcctgcacagccccaccgccgcctccccgggctggctcgcccgctacccgcgcggctgaaccccgacccccgcacctgacgccccctcaacattcgggggtccagcccgtaccgtggcgggtcccacgtctcggaggtgccagagcccatgcggatcgccacgaccatcttcctcaccgaccgcaccatctctcccgtcgggctggcccacagcctcgaagagcgcgggttctccggcctctacctcccggagcacacccacatcccggtcacccgcgagaccgccgcgcccatgggcggcgaactccccgagatgtacgggcgcaccctcgacccgttcgtcgccctcggccaggccgccgccgtcaccgaccggctccagctcggcaccggcatcaccctggtctcccagcacgacccgatcggcctcgccaagcaggtcgccaccctggaccacctctcccacggccgtttcaccctcggcatcggttacggctggaacgtcgaggaggccgccgaccacggcgtcgagtggcgcacccgccgcgacctggtccgcgaccggatggccctgatgcgcgccctgtggtccccggagcccaccgcgtacgtcggccagtactgctccgtccaggccagcaccgcctacccgaagccggtccagcccgcgcgcgaactcggcccgggcgcccccctgtacggcccgcgcaccctgatcggcggcgcggccggccccaagctcttcgccgccatcgccgaccacgccgacggctggctccccatcggcggcggcggcctcaccgagtccctccccgtactgcgccggctctgggagaccgccggacgcgacccgaagtccctccaggtggtcccgtacgcggtccggcccaccccgggcaagatgagccattacgccgacctcggcatcgaggaggtcgtcctccagctcccctcggcgtcgaagccggaagtcctgcgcacactggacgagttcgcccagcacctctgagcggcctcctggtccgccgaaatcccctcgacgacgcgccaccaccccgccgatcatgactccatgacgaaccgagcggcggacggcgtggaccgggacagcgagaaccagtgggcggcgctcccggagggcatccgcaggcaggccgacggatacgtcctccaggaccgctacatgcaggccgtcaggctggtgtgggacgccggccgcgccggggacgtcggcctgaagcaggcccagctgatcgtgagcatgcgctacgagcaccacggggaccgggtggcccgcacgcccgactgcccgatcgacttcgactcgctcgccgccctcgcccacggcataccgggccgggtggtggcgatcgaggccgtctgggacggggacacggtgcacgactggttcgtgaacctgctggccctcacggaggagcccgtcgggcagaagtgcctcgccacgatctactggggcacggcggtccgggccctgggcgacgccgacaccggcggcctccacccctcggcgaccgccgccacccacgcgggcaccgccctggccgagcacctgggcgtccccttccacttcgcgagcccggacaccccggacgaggaggctccgcgctggcgtagctgacctcagcccgcccagagctccggtacgccgtccaggagcaccacggcggcgacgggctccccggcggaggagcggcccagccagacgggatggacgccgtccgagctcaggccgaagccggccagcccgacgccggagccgggctcgcgggtccgcaggaagaagtcggagtcggtgcctatcgtccagccctcgtcgtcgtggtcgtggagcgccgccacgaagcgccgctggagcgaccgccacgccccggcatcggcgaaggcgcccatcgcggcgtccgtaccgaagccgtacgcctcgccctcgcgcagcagccacgggtcgtcgcccggccccaggagcatctcccaggacacggcggggccctcgccgaggtgcacgcggacggcggtgccctccgcacgctcgccctcctccgcggcctgggcctcgtccagccggtactcccccggcgggacggcgaggaccaggcgcggctcgtcgtcctgcgcggggcatccgatgcccagcagcccgccgggcaggcagagggtcccggcgggcctcggctccgtggaggtcatcacgccgccgtaggggctcgccatggccataccgggttggaacagcctgccgaagtcgaccgaggtctccatgggggacggcacccgccgccaggacaccggtgcttccggtgtcccggcggtggccaggtgctcccgtacccactgcggcaggtggtcgtcggccgtgaacggccgccacccgccgaaggcgggccgggcggaccagcactggtcctccgggacggtgagctccgcctccagcgaggagccgcgcacgcccgtgggccggtgcgcgatgcgcccggtgccgtcggaggcgatctcgaccacggtgcgcggacagtcctgggcggactcggcggtcgccggaccgggatactgccagccggtcaggcgccggttcagcagccggtcctcctccaccagcatgctcaggtccgcttcgaacgtccgacggccctgctcgtcgtacgcccacacctcgaccaggccgctccgccaggacacccgccgcaccacggccggcagcgcccgccccggaacccggtgcagcacggcgtacgtcagcccggcggcgtcccgctcccgcgcctccccggcggacaactcccgccccgccacccgtgacaccggatcccacccgtccgcgtactccatccgcatgccgccgcccccgtccgctcacgcccgttcccgcacctgatcgcacgataagggctgccaccgacagcgctcgggccggacgcctacgtccgcctcccggcccggtgcgtcagctcggcccagaccgtcttgccgatcaggcggtcccgtacgccccagccgacggcgacggcgtccacgatgcgcaggccgtagccggattccgcctgataggcgtgcggccgtacggcggggcgccggtccgcgcggccgtcggagacctcgatgcgcagcacgccctccagcagggtcatccggagctcgaagtcccgcccgggaacgcgcccgtggagcacggcgttggcggcgagttcggccacgacgagtcccgcgtcggcggcgagcgcggtggtttccgggatgccccagtcgtggagttcgacgagggccagctgtcgggcgaggcacgccccgcggcgggtgcagctgaaacgctgagtgaacacgcgtacgagggcccgggcggagccggaaggtgcggtcatggcgtcaacatcccgcttggcctgggtcgttcaacaccaagcggactcgtacaaaccaactgtacgagttcactccctggacagtggaagtaacgatgcgtgagcatttcccccggggaggtgaccgccatggtgagtgccgacggcagcggtgacggcgaggtcgaaccagacgacaacctgcgcagcttcggcgagaccgtcaaggcctcccgcaaacgcgtcggcctgacccaggagcaactggcgccgctgatcgggtactcggtccagtacgtcgggtccgtggaacagggccggcggcatccgtcgaagaagttcatcaccaagaccgaatcggtcctggacaccttcggcgtcatcgacatcgcggcccggcagctgtcgcggcgacgcggcctggcgtcctggttccgccggtgggcggagctggaggagggcgccgtcatcctcaacacctacgagtgccggtccgtcccggggctgctgcagccggagtcctatgcgcgcgccctcatcgcgaacgtcccgcccctggccactcccgaggaggccgatgcccgggtggcggcgcgcatggaacggcagaaactgctgtaccgcacgccgtacatcctcttcagcttcatcatcgagcaggcgctgatcgagcggcagacgggcgggccggaggtcacgcgggagctgatcgaccggctgctggagtgcgggcggctgcccaacgtggacatccagatcatgccgacggcaagccccgaacacgcgggcaccgacggcccgttccgcctactggaaaccgatgaacacgagtggctggggtacacagagggacagcagtcgggacaggtgatttccgacccgaaggacatcagcctgctccaccagcggtatgccaaacttcgcattcaggccctcaaccccgccgacagcgcgggcctgttgatgcgattgagaggttccctgtgaccagctccgacttgcggtggttcaagagcagctacagcggcagccagggcgacgactgcgtcgaggtcgccgcccgtgccggcctcgtccacgtccgggactccaaggtgacggccgggcccgagctggccgtcacgggcgcgagctgggacgccttcctggcgggggtcaccgcgaacacctgaggctacagagggtgaccgccattggggtgaaagaccgtttcccgtgaactctccgtgatgttgagctggtcgcgtgccgtctgtccggcgcgtcgatcgagatcttaggagagtgtcatgcgtattcgctctgccctgacggcgtctgtcctggccgccggcatcctgctgggcggcgccggcgcggccctggccaacgacggtgtcgacatcgaaggcttctccgccggccacaaggccttcgcctcccactgctcctcgttcgccggtgttccggcgaagatcggccccctgtacgccgacaactgcgagaacgagggcgagaaggactgggccaagggctaccacctgggcgcctgaccaccggcgtccgtcggccggggcccgtcacccagggtttccggccgacgggtcggccgtggaccggtcggcccaaccacgcctgatccggcggggtttcgtaccctggcattcatgatcgattcacatgcgcatgtccgcgtcgcccggccctcgctcgacctggcggccgccgagcggttctacgtcgacgggctcgggctggaagtgcagtggcggagcgccgagagcgtggccggggagcacgacctgctgatggtcggcccggccgggggcggctggcacttcgagctcacccgggacgactcgaacccgatcgtgcccgcgccgaccgtcgacgacctgttcgtggtctatctcggcgaggctcccgacgaggccctcgtccagcgcctggtcgagcacggcggaacccgggtcgccgcccacaatccgtactgggacgagtggggagtcacggtcgccgaccccgacggctaccgcctcgtgctctgctcccgcacctggggccaggccgccgcgtcctcgtagtccgggcccgcggatacgacgcgcgtccggcagcccgtttcaggcgagggccgggtagtccgtgtagccctccgcgccgtgtacgtgcatcaggaactccggccggatctcgttgagcggcgcgtccgtgcgcagccgctcgacgaagtcggggttggcgaggaagccccggcccagcgccacgaggtcggcgccttcggacagcaggcgttcggcccgccgcttgccgccgtcggccgcgacctcctcgcgggagagcgccgggttggcgatcagggtgccgggccagtcgcggcggatctgtgcgaaggcgggccggtcggggtcggcgtggacctggtgcaggtaggccggtgccaggtcggtcagggccttgaccagggccgggtagatctcctcggtgtcgccctcctcgatcccgttgacgttgattccgggcgagacgcgtacgccgacccgctccgcgccgatggcctcggtgacggcccggaccacctcgacggtgaaccggatgcggttctcgaccgggccgccccactcgtcggtacggcggttggtgttggcggcgaggaactggtgcagcaggtggccgttggcggagtgcacctccaccccggcgaagcccgccccgacggcgttgcgggccgcgctcgcgaagtcggccaccgtggcccggatgtcctcggccgtcatcgcacgcggtacgacgccgtcgcgcaggccgccgggggtgtgcagctgctcggggaacggcaccgcggacggggcgagaggtacgtacccgctggtgtcggggtggccgacccggccgccgtgctggagctggaggaacatctccccgccgccggcggcccgcacggcctcggtgacccggcgccacccggcgatctgtgccggagtgtggatgccggggatgtgcgggtaggtctgcccggcggcgttcggtgtgctggcctcggcgatgatcaggccggccgaggcgcgctgcgcgtagtacgtggccatgagttcgccggggactccgtcggccccggcgcggttgcgggtcagcggggccatcaccaggcggttgggcagttccaggccgccgagccgggcggatccgaagaggcgggaagcggcgggaccgtgctgtgtctgcgtcatgccggtaccgtaaaagctgacactggtgtcaggttcaagggctggggtggggcatgcggatcggtgaactggcggcgcgcaccggggtcggtgagcgttcgctgcgctactacgagcagcagggcctgctcgcttcggaccggacgcccggcggccaccgggacttccccgagcgggcggtcgaccgggtcatccggatccaggagctgtacgcggccggcctgcacagcgcgaagatcgcacagatcctgccctgcatgcgggacgaggacggcggcccgtcggtgcgcgccactccggcgctggtggccgaactcgccacggagcgggagcggatcgaccgcatgatcggtgatctggtccgctcccgcgaggtgctcgacgaggtgatcgaggcggcggcgggccgcgcgacggtcgcttaggccgtgtcgtcccccggggggaccgggggtgtgcccggcttcgtgtggaggacctcgcgcgcctgttcagcggcgcgggtcaggctctcggagacgaagtccatgaagcgggcgatgttctccaggcggttggcggccggggtgtcggggccgaggactccgacgccctgacgggcggtttctatgatcagggcgttggcgcgggcgctggcgatcatcgcctggtaccagacgtcgtcgtcgacgaagtagcgctcgcggcggcgttcgtcgcgttccctgcggacgaggccctggccctccaggaacgtgatggccttggagatggatgccgggctgacctggaggcgctggacgagttcggacgcggtgaggctgcccgagtccgtgatgtagaggcaggacatcacccgggccatcatcttgggcgtgccggcctggatgaggacgtcggtgaacacgtcctcgaactcgcgtaccgcctcggggtcgcgtccgtgggcctgcgggagcgcctccggtccccgcggggccgcctgaccgcgccggtgggcacggcgttcggtggcgcggtgggccaggtcggcccggtaggcgttggggccgccgttgcgcatcacctcgcgcgagatcgtcgaggtcgggcggtcgaggcgcctggcgatctcggcgtaggcgaggccgtcggccagccccagcgcgatctgctggcgttcctgctgattgagcctgcctcccggcatcgcggtctccttcatggtccgtggtgtctcccactatagcgttcaccgtcattccattgcaacgcactggcgcatcaccgttgcgttaagctcgaaaccattgcaatgaaatcttatccctgacctgcaacaacaaggatgcaacgcaacgagagtgttgccagttcagcgaacgcaacgtagcttttcgttcatcagaaaccgcggggcgcacaaggcgcagccgctgatgaaggagaagcaccatgcagaagttcgccaccaccgccccgatcgccgccgtcctggacgtcccggccgggctcatccggttcatcgccgccgaccgggccgacaccaccgtcgagatcctcccggccgacgcctccaagggccgcgacgtgaaggccgccgaacggacgaccgccgagtacaaggacggtgtactgcggatcgcggccgcacccccgaagaaccggatcctcggcaactcgggctacgtcgagatcaccgtccagctgcccgccggctcccgcgtcgaggcgaagacggcggccgccgagttccggggcgtcggacggctcggcgacgtcagcttcgagagcgcccagggcaccgtcaagatcgacgagaccgcgagcgcacaggtcaccctcatggcgggcgacgtctccgtcggccgcctgggcggcccggcgcggatcagcacccagaagggcgacctccagatcgccgaggccgtgcacggcaccttcgaactgtccacccaggcgggcgacatcaccgtcggcgccgcccgcggggtctccgcctccctggacgccggtaccgcgtacggccgcatccacaacgccctcaccaacaccgacggcgccgccgccggcctgaacatccgcgccaccaccgcctacggcgacatcagcgcccgcagcatctgacccgcagccaccgcgtccgaaggagcactccccatgaccaacctggccatcgccgcgcacgggctgcgcaagtcctacggcgacaagctcgttctcgacggcatcgacctcgcggtccccgccggtacggtcttctccctgctcggcccgaacggcgccggcaagaccaccgcagtgaagatcctctccacgctcctccgcacggaccccggcacgggagccgtccacgtcaacggccacgacctggccgccgacccgcaggccgtgcgcgcctcgatcggtgtcaccggccagttctccgccgtcgacggcctgatcaccggggaggagaacatgctcctcatggcggacctgcaccacctctcccgccgcgaggggcggcgggtgaccggcgaactgctggagcgcttcgacctggtcgaggccgccaagaagccggccgccggctactcgggcggtatgaagcgccgcctcgacatcgcgatgacgctggtcggcgccccgcgggtcatcttcctcgacgagcccaccacgggcctcgacccgcgcagccgccacaacatgtggcagatcatccgcgaactcgtcaccggcggcgtcaccgtcttcctcaccacccagtacctggaggaggccgaccagctcgccgaccgcatcgccgtgctcaacgacggcaggatcgcggccgaagggagcgccgaggaactcaagcggctgatcccgggcggacacatccggctccgcttcaccgacccggccgcccaccggtccgcggccctcgccctgcccggggtcacccgggacgacgaggcgctggcgctgcagatccccagcgacggcagccagcgcgacctgcgcacggtcctcgaccggctggaggccgccggcatcgaggcggacgagctgaccgtccacacccccgacctcgacgacgtgttcttcgccctcaccggcccggccggcatccccaaccagtccaaggagaacgtccgatgagctccctctccctcgccgcccgcgactgctccacgatgctgcgccgcaacctcctgcacgtccggcgctacccgtcactgactctgaacctgctgctcaccccggtgatgctgctgctgctcttcgtctacatcttcggcgacgtgatgagcgccggcatgggcggcggagccgccgaccgctccgactacatcgcgtacgtcgtcccgggcgtgctgctgatgaccatcggcagcaccgtcatcggggccgcggtgtccgtctccaccgacatgtccgagggcatcatcgcccgcttccgcacgatggcgatccaccgcggctccgtgctcatcgggcacgtcgtcggcagcgtcctgcagtccctcgccagcgtggtcctcgtcggcgccgtgggtgtcgccatcggcttccggtccaccgatgccacggccctggaatggctggccgcgttcgggctgatcgccctcttcgccacggcgctcacctggatcgccgtcgggatgggcacggccagcccgaacgccgaggccgcgagcaacagcgcgacgccgctgatcctgctgccgctcatctccagcgcgttcaccccggtcgaggcgatgccgggctggttccagccgatcgcccagtaccagcccttcaccccggccatcgagaccctgcgcggcctgctcctcggcaccgagatcggctacaacggctggctcgcggtcgcctggtgcatcggcctgacggtgctcggctaccgctggtcggcggcctcgttcaaccgcgacccgaagtaaccggtatgagcgagcgggacccctcccgcaccaccgtcccgcccctgggcggcgtacccgacacgacggtcggagtacgccgcccgtcggcgttcgtccagaggtgcttgaacaccgaccacaggcggcggccggagccgccgtcgtggtcgggcacccggacggtggaggagtgcggggcgcgcggtgccgcctgggcggcgagggcgccgtacgcccggcaggctcccgcgacggccagcgtggccagggcggccgcggcgacggtcaggacgacccgccggcgccaggtgcgggaaccggcggcggtgccggtacgggtgggcgtgcgggtgtggaggccggccatgggagtgctcctcgggaggcggaggcgtgcggcgggggttaggtcgcctctttcggatcttggcggatgagcccgggtcgtccggtgcggtgcctcgcaaggcggaggggcgcccgtgtactggacgtactcgggcgctccgacaacgcggcgaggtgccgtgccgggcgggccgggcccggcaagatccgaaagagacggcctaagcccgtgcctccagtcagcccgagggagccgatcgcgtcacgtcgctgaagttcgggacttgacagcccgcgacccgctcagccggcggcccagaacctcgccagagccgcctccttgtacggggccgggctcacgctcaggtcccccgcgaaggggcggtccagtgccaccaccagcagcaggctgaagccgatcagcccggccaccgccgacacgaagagcagctgcatcttcaggctgcgcagcccgaacaggaaggtcagcgggacgatcacgaacgcgcccccgtagaccagcacttggagcaggacgggcagtgaggtctcggccatggtgacgcgggcccggcgctgggtgttgacatcgttcagacgggtgacggcttcggcgtagaaggtctcggcgcgggggccctgcggctcgtacgccatgagggcccggtagaggccctgggtctgctcgccggtcgcctcgaagctcggccggcccacgcgcatgagcggccactgcacctcgacgacggcgtgcgtgtacgcgcccaccgcctggtgcacgcgcgcccggtcggcgtcggggaaggcgtcggcgctgcgcacgacggcggcgagcccgctggcctcggtggcgacgatggtctcggtgttctcccgctgcgtccacagggtgacgacgacgaaggcgaggatgatgccgtagatcgcgccgaacatgccgagcgcgaccccgaccatctcgttgtgctcgccctgggccaggtgcgggaaccggcggcgggcggccacgctcccggccacggcgaggccggtgatgccgccgaccacgaggacggcgatgacgaaggtgctgaggtggttgagcagccagaggatcatgtcctgcccaacgagcgaggccgcccgggaacccggcccccgccgcggctcctgcggggtgggagccgcggcggcgccgagccggcctgaggcccggcggctcgggtcactcgaccttgggggcctccgggagcccggcggccagggccgagccggtgcccctgagggaggagtcggtggcctgggtggcggacccggcggcctgggcggtcacgcccaccgcggtcttggtgtcctgtacggcctgggtcgggtggtcgacgatgtcgacgacgcggccgacgaccgggggcgcctgcccggcgggctcgtcggcgtgcgcggcgacggggatcagtgcgagggcggcgccaccggagacgaccagggcggagagggtgcgcttcatggcgttcatgcccggcccaacgaccccgccacaccccgggtcaccgcccgcgaccgcgcgaagtgcgcccgctacgcccgcggccccggatcgggggaatcgatccggggccgtgggcatgactcagcggggtgggcgcggggcgcggggtcggtcagtcctcgaccaccagggacggggtggacttcgtcaggacctggccgcggaagaaggcggggctgcggcgctcggtgacgaacatgatcaccaggccgagggccagcaggccgacgccgatgacgaagacgttgccgacgtcgaggccgggcagcgtggagccggagccgtaggacgggtcccaggcgtcgtacagggtcttgaagaagaccgcggccagcagcaggccgcccaggaccgggaagacgcccttgaagaacaggtcgcgggcggagcggcgcagctcgccgcggaagtaccagacgcaggcgaaggccgtcagcgagtagtagaagcagatcatcaggccgagcgcgaagatcgtgtcggtgaggacgttctcgctgaccagggtcatcaccgtgtagaagacgccggtcgcgacgcccgccatgacggtggcgcggcccggggtcttgaagcgcgggtggaccttggcgtaggagggcggcagggcctcgtacgtcgacatggcgaggaccgtgcgggccaccgggatgaaggtggtctgcagggaggccgcggcggaggccaggacggccacgaagagcaggatgccgaggaccgggcccatgacggggccggcgagtgcggcgaagacgttcccggaggtctcctcgttggcgaggccgaggccctcgccgccggagccgacggccatctgggcggcgacgccggtggccaggtaggagccgaccaggacgatcatcgcgatgagcgaggcacggccgggggtcttcgtggagccggtggtctcctcgttggtggccaggcacgcgtcccagccccagtacatgaagatcgagagcgagagtccggcggtgaaggccgccatggactcgaccgcgaaggggttcatccaggaccaggagaagtccaggccggtgtcgaaggtgccggcggaggccttctggaaggccatggcgacgaagatcgcgagcacgacgagctggagtccgaccagggcgtactggacgcccttggtggcggtcataccgcggtagctgatggcggtggcaacggcgatcagggtgaggcaggtgacgatgtggacgagcttgtcgtcgtccagggccgcgatcgacgcgttgttcgtgatctcgccggccagcagccagaagtacgaggtggcgacgcccgcgaggttggagagcacgatgatcgtggcgatcaccaggccccagccgcacatccagccgatccgcgggccgaaggccttcacggtccaggtgaaggaggtgccgcagtccggcatggccttgttgagctcgcggtaggcgaaggcgaccaggagcatcgggaggaagccggcgaggaagatcgcgggcatctgcatgccgacctcaccggcggtggagccgagggtcgaggtcaggcagtagaccggggcgacggtggagatgccgatgacggcgcttccgaccagtccgacggaccccttgccgaggcccttgccgcggacgtcgccctcgacgacgccgcttaccgtgtctccggcccgaggccgaacgtccagctgagtcatgagtcaggacgttagatggtgcgttttccacatatggatgatcggcgtccggaactcggagccttcgaaagccttcgaatccagacagcgacacggttcatgagcacttaatacaaggttcactttgccatgcgcccgcgcttcggaaggctcggccaagactctttcggcatacggaaaccgtagccatgtccgttttgcgagtattcaaagtttccgtcgtgactttgcggtgaccagcggtaacaggcaggactgctcgtcccggacgggcccccggaccgggacgtcatccgcgagactggccccatgcccacggccgatgagctcctcagcgcggacaccgtcacctcactcgcccggctgctcgcgagcgccgccggccgccggtcctcgccggccctgctcgcttgcgccggcgccctcgacgggctggccttcagcggccgcgtcgccgccgtccgcgacgccgtgctcgacgacctgcccgacgactggcccgccttcgaggccgtcgtacgcaccgccctcgcccggcccggcttcgagggctggatgaccttccccgtcaacgaggccgtcgccgtccgcgggctggaggcgttcgagcccgggctggacctgctgcacgacctcacctcccggctgaccgccgagtccgccgtacggcccttcctgcgcgccgacccggcccgcgccctggccgtcgtacagaagtggacggacgacccggacccgcacgtacgccgcctcgccagcgagggcacccggccccggctgccgtgggccccgcagctggcccgccttcgtcgccgacccgcggccggccctgccggtgctggacgccctctaccgcgacgggtccgagtacgtccgccgctccgtctccaaccacctcaacgacatcgcccgcgaccaccccgccctcgcggtcgagaccgcggcccgctggctggccgagcccggggccacgaccgaccgcgtcgtacgccacgggctgcgcacgctgatcaaggccggccggcccgaggcgctgacgctgctcgggcacgccccggacgtaccggtcaccgtgcacgggccggtggtgaccaccccgcgcgtcgccgtcggcgagtacctcgtcttcgactgggcggtcaccaacaccggcgagctcccggccgagctggtcatcgactacgtcgtgcaccacaccaaggcgaacggcacccgcaccccgaaggtcttcaagctcgtcacccgcccgctggccgccggcgagaccctcggcggcaccaagcggcactcgttcaagccgatcaccacccgccgctaccactcgggcgagcacctggtgcagctccagatcaacggccgggtccgcggagaggccgctttttccgtggacgccggatgatcactgcggcatgctgcacgtcatgacctacggaatcgagtcccactccgcccgatgagcgtccgcgacgagcgcgagccgctcgcccccaggacgatctccctctacgaccacgccctctccctccgcggcggcgagccggacgggcgtgtcccgcgcaacggccgtcccctgcccgacggatccccgccggagccctcccgcaagggcctgacctgggaagaggcgcggttcgaagtcaccgccgcgctcaccgatcccctctgcgaccccgaccccgtgagagccgccgaggtcctccaccagcgggcccgccggctggtgatgccccaccgcaccctgcgcgcgcacaccgcgcgactgcccctgagcgacgaggaagccgcccggcgcaccgcccggcaactgacccgcaccggcaccaccgtggcggccgtcagcatcggcatcgccctgctgatccgcctcggcgagcccgaggacgtgccctgcctcaaggccctcggcacactctccggcctcggatccgcggcgagcgccgcactcgacccgctcgaccgtcaggcggccgccctgctggtcatccgcggccgcgaccgggccggggagctgacaccgctgaccgaggcgatcgccaccggcgacgcggaggccacccggtccgccctgctgtccctgccggacgaggaccgggccatgtggctcgcccggcgcatcgccgaggccgccgacctgctcgggctgctccgggcccggcctcgggacgccgaactgctcgcgctgaccggccggctgctgcaccggatggccgacccgcgcagcagccgccccgagatcctcgactacctgcccgcccgggccgtgtacgaggccctggtccggcacgccgaccggctgcccccggccccggagcaccggtcgctgctgctgtcggtcgccctcgacctgcacagcggcccggccgtcctgctgaactggcggcccggacggcgccgggccctgctcgacgccctggaccggctgttcgccggggccgcgccgggccccgtacccggcgaccggcgggcgggatggttcccgcgcaaccggcacctccccttcgcacggaccgaggccggtgaccgcccgcggtgggaggtggccgtcgtccacgcgtccgcggactcctccgccgtcgagacgcggatcctggccgacggggtcccgctcgtccccgcgctcttcgggaaggggccggggctcccgcccgagtacctgctcgacagcggcgcgctgcgcgccggaccggagccgcgggaggtgcagctcgcccaggcggactgcaccgagctgtgctgcggcgcgctgtacgtgacgatccgccgggacggcgacgaggtggtgtgggacggctggcgcggtgcggtcggcccgcagccgcccccgtaccgcttcgacgcggccgcgtacgacgccgaggtcgagcgcgccgagcgggacctgtcctggtgctggccggcccgcagcaccgcccggctgatcgcggccggcctgcgcgaccgccccggactgacgggccggtgggaactcgcgccgcgttggatcggcaccgactggcgggacccggacaccacggtggtccatctcgcgtacacgccgtcttcgccgcctccgggcaccggcggatcgctgtacttcgagtggcggctgcccgacgacgacggcccgccccgcgaccgggcggccgccgccctgcgccggctggagacggacgacccgaagggcttcgcctcgttccgcggcggcgacggggaactggccgcggccctcggctaccgagagcccccgcgcaccgggcgcgcaccccggacatgacacggtccggccgggggcacccgcccccggccggccgcggccatgccctcagccggtccagacgatcgactgcgtctcgctgtaggcgtgcagcgcgtacgagcccacgtcgcgccccaccccgctgcgcttgaagccgccgaacggcgcctccatgttgcggccgatggtgttcaccccgacgccgcccgagcgcagccgccgcgccacgcggaacgcgcgcgccgaatcccccgaccacacgtagctcagcagcccgaagtcgctgtcgttggcgagccggatcgcctcgtcctcgccgccgtcgaaggggaccaccacgaccaccgggccgaagatctcctcccggaccacccgcatgtcgttcgtgcagtcgacgagcagggtgggagccacgtagaagccgcggccgtcgccgaccacggggcgctcgccgccgtgggcgatccgcgccccttccttcctccccagctcgatgtacgactccacgcggtcgcggtgcgccgccgagatgaccgggccgacgaccgtcccggccgccgccggatcgccgacctgcatgaaggccaggtagccggtgagcttctcgatcagccggtcgtggaccgaccggtggacgatcacccgggtcggggccgtgcagatctgcccggagtagaaggagaaggtcgtcccgatccccatcaccgccgcgtcgaggtccgcgtcctcgaagacgatcgccgcgcccttgccgcccagttccatcagctgccgcttcatcgtgcggccgcagacctccgcgatgcgctgcccgaccgccgtggagccggtgaaggacaccatgtccacgtgcggggagtccacggcggcctcgccgacctccaccgactgcccgcccacgacgttcaccacgcccgcgggcaccccggcctcgtgcagggcgtccgccatcctgaacaccgacagcgggtcctgcggcgccggtttgaccaccaccgtgttgcccatggccagggccggggccaccttgcccgccgggttcgcccacgggttgttgtaggaggtgatgcaggtgaccacgccgaccggctggcgtacctccagcgcgcccaggatgctcgcccgccccatcggtccggcttccgtgacctgtggcggcaggcccttctcgaccggctccagggccccctcggcgtaccggcggaagcgggcgacgccgacgcccacctgcatgccgcgcgcgatgccggtcggcgcgcccgtctcggcccgggccagcgccgtccacggatcgaactcgcgctgcatgatgtccgcggcccggtccaggatcgccgcgcgggcctcgggcgtcgtccgcgaccagctctcgaaggcctcggccgcggcgcgcgccgcctcctcgacctgcccgcgcgaggcctcgggcgcgagcccgaccaccgactcgtccgccgggttgatcacctcgtagtgaccgcccgcgggctccacccactcgccgccgatgtagagccgctgcgctgcgccggtcatcgggtgctcaccgtcctcgtgtcccggccggaccggagcacggtgcccggaaccgcccccgtcacctcgtcgtcgcggatggtctccacgccgttgacgcgtacggagacgatgccgatggcccgcgcgtccagccgcgggctgtccccgggcaggtcgtggaccagggtggcgggaccggcctcgatccgctgcgggtcgaagaggaccaggtccgcgtggaagccctcgacgaggcggccgcgctcgcgcagcccgaacagccgggcggggtcgtcggtgagcatccgtaccgcctgctccagcggcaccagcttgcggccgcgcaggcagtccccgaggaagcgggtcgtgtacggggctccgcacatccggtccaggtgcgcgccggcgtcggagccgccgagcatgacgtcctcgtgctgccaggtctcctggcgcagggcccagctcgccgggtcgttgtcggtgggcatcggccagagcaccgtgcgcaggtcgtcgtgggcgcagatctccacgaggcactggaacgcgtcctggccgcgttcggcggcgatgtcgttcacgacccgcccggagagcccctcgttctccttgctgtacgtgtcccctatgacgtaccggccgaagttggcgaggcgccggaagacgccggcctccttgctgtcggcgcggcgcagcatctcggcgcgtacgtcggcgtcgcggagcttctcgatccgctcggggacgggcaggccgaggatctcgccccagccggggatgaggttgagcgcgcagaaggtccccagcgacatgttcatcggggtcaggatgggcatcgtcagcgcgacgatccggccgcccgccttgcgggcgcgctcgctggggatcagctggcgcgggacgcgctcggggacggaggcgtcgatggtgaggacgttccagttgaggggccgtccggcggcggcgctcatctccacgaagaggtcgatctcgtcgtccgagaactggtcgaggcaaccggcgacgatggcctccagctgggtgccctcgtgttcggcgaccgccttcgacagcgcgagcagctcggcgggcttggcgtgccgggaggcgacgggggcgccggacccgtcggagtgggtggaggactgggtggtggacaggccccaggcgccggcgttcatggcgtcgtggaagaggtcgagcatggcctggagctgctcgggggtgggctggccgccgacggcgtcctcgcccatcacgtggcggcgcagtgcgcagtgcccgaccatgaacccggcgttgacggcgatccgtccctccagggcgtcgaggtactcgccgaaggtggaccaggtccagtcgacgccctcctccagggccttgagggccatgccctcgaccttgctcatcatgcggcgggtgtagtcggcgtcctcggggcgggccgggttcaggggcgccagggtgaagccgcagttgccgccggcgacggtggtcacgccgtggttcatggacggcgtggcgtacgggtcccagaagagctgggcgtcgtagtgcgtgtgcgggtcgatgaagccgggggtgaggaccagcccggtggcgtcctcggtggtgcgggcctcttcggtgacggtgccgggctcgccgatgacggcgatgcggccgtcgcggataccgaggtcggcgacgcgggcgggggcgccggtgccgtccacgacggtcgcgcccttgatcaggtggtcgagcatgacgtcccttcgcacttgagcctcgccggcgtgcgaaccgccggcgaggctggttgtggccccggccggtggccgcccggccggggctgggttcggggcggcggtccgggaagacgccgtccccgtactggggggctacgcggactgacggaagcgggtcgtgcggtggaccgggtccgtgtcgatgtgggggatcacgtgttcgccgatcagcttgatcgtcgtcatcgtgtcctcgggcgagacaccggtcggcagaccgaaggagagctggtcggcgccggcctgctcccagcgcttgcactgggcccggacctccgacgggtcgccgcagatcagcagttcctcggcgatcagcagttcgatgatctccgcgttgtactccggcagggtctcgggccactgcgggatcgcctcgggccgcgggaaggtgtcgtggtagcggaagaccagcgactggaagcggttcatgtgggcgttgacggcgatctcgacggccttgtcatgggtctcggcgcagatcgcggtcgaggtgaccatgacgttgtcgttgacgaaggcgccgatggccttcgcctcccggacggccgtcttgtactggtcgaggacccactccatgtcggagaccttctgcacgctgaagcccagcacgccgaggcccttcttggccgccatcgcgtacgaggacggggacccggccgcgtaccacatggcggggtgggccttcccgtacggcttggggaagatcttccgcggcggcagcgaccagtgcttgccctggaacccctcgtactcctcctggaggaacatcttggggaactccgcgatggtctcctcccagatctccttggtgccgttcatgtcctcgatgcccggcaggaagccgaggatctcgtggctgccggcgccgcggccggtgccgaactcgaagcggcccttggagaggtggtcgagcatggcgaccttctccgccaccttgaccgggtggttcaccggggcgagcgggttgaagatgccggagccgaggtggatgcgctcggtggcgtgggcgaggtacccgaggaacacctcgttcgccgacaggtgcgagtactcctccaggaagtggtgctcggaggcccaggcgtacttgaagccggacttgtccgcctgtatgacgtactcggtctcctcgatcagcgccttgtgctctgcctcggggtcgaccttggaccgcgcctcaggcacgtatccctgcacaaagagcccgaattccaagggggttcaccgtcctttggtttctgacgttccgtcagattcgatgtcccgactgttccactgcggaggcacgagcgtcaatacctgacgccccatcagagaatgctgacgcccgccatccagccgccgtcgatcacgaacggctggcccgtgatgtaggaggagtcctcgcccgtcaggaagagcgccagcttcgcgatctcctccggctgccccacccgccccatcgggaccacccgcttgtagagctccgccatcgcgtccctggcctcgtcggtcatgttcgccgggtccagcagacccgggttggccatcggggtgtccacggcgcccgggcacatcgcgttgacccggatgcccttgcccgccagctccagcgcggccacccgggtgaggccgaggatcgccgccttggtggcggcgtacgtgccgacgtacgccatgcccgtcaggcccgtatacgaggaggtgttgacgatggtgccgcctccggccgcctcgatctcgggggccaccgtcttgatgccgaggaaggcgcccacctggttgacctggaccacctgctggaactcctccagcggggtcgcggtcagctcgttgaagcgcaggatgcccgcgttgttgaccaggccgtcgaccggaccgaaggcctccttcgctgcggcgaccgcggccgcccagtcctcctcccggctcacgtccatccgtacgtaccgggcccgatcctcgccgatgtccttggccaccgccgcgccctgctcgtccagcacgtcaccgaggagcaccctcgccccctcggcggcgaagagccgggcctcctgctcgccctggccgcgtgccgcaccggtgatgatcacgacacgcccgtccagcttgcccatgtccgtcagccccttgtcgctcggtcgcttcgtcgttcggtcgcttcgtcgttcagtcgttgaggaggggggccacctcggccccgaaagcggtgatctgatcgacgagttcggcgcggtcgcggctgcggaagcgcacctggatctggtccacgccgagcgccccgtactcccgcagcgactcggcgagcgcctccgccttgccggtgagggtgcggcggccggtgtcccagccgggctcgccgacgtacagcgcctcggtgatcgcaccgaactcgaagggcccgtcgacgccggcctcggcgcgcagccgcgcgatacgggcgatctgcgccgggagcctgtcgcgcgggtcgccctgcgggagccagccgtccccgcggaccgcggcgcggcgcacggcggcggccgaggagccgccgacccagacggggatccgctcctgcgcgggccgcggcagctggccgaggtccttgaaggagaacagctcgccctcgaattccgggtactcctcgggtccgagcgccgcccgcagcgcgtccagggtctcgtcgaggacggccccgcggcgcgcgaagtccacgccgaggacctcgaactcctcctgcacgtgcccggcgcccaccccgaggatcagccggccgccggagaggtggtcgagggtggcgtactgcttggcgctgatcagcgggtggcgcaggcccaggatcgccacgtggctcaggagccgcacgcgctcggtgatcccggcgaggaaggacagggtcgccaccgggtcgtaccagacggtgctcatgggacccgcgagccgtcgcgggatcgccacgtggtcacaggtggccacgtacccgaagccggcccggtcggcggcccgcgcgatcccggcgagatcggcggcggtggccgacgcctcccagggttcggcgtagatggtgctctgcgactggaccgggagctgcatcccgtagaccagccgaccttgcggaaatacgcgcgccatggcgggcccgcctcgccttcgtctgccgattcgtcatatcggtgcggggccatcgtcgtagctgacggatcgtcagacaaggggtgcggcacacctcggaccgaacggggcgttcccgcgccccgttccgtttccccggtcccctcgctagggttcgcgcgtggatctgatactcacactggtcagcgggatcgcctggacggtcgtgtacgtggaggcgatccgcgtcgggctgcgggaccggacgtacgcgatgcccgtcgccgccctcgcgctgaacttcgcctgggagaccacctacgcggtccgcgacatctcggtcgggatctccccgcagggcgtggtcaacgtggtgtgggcggtggccgacgtggtgatcgtctacacctacctgcgcttcgggcgggccgagctgccggagttcgtgacccggccgctcttcgccggctggtcggtactcgtcttcggtaccggattcgccgtgcagtggctgttcctggcgcacttcggggtgcacgacgcgacccggtactcggctttcctgcagaacctgctgatgtcgggcctgttcatcgccttctacgtgtcccggcaggggccgctcggccagtccctgacgatcgccgtcgccaaatggctggggacgctcgccccgaccctgctgttcggggtggtggaggacgcgccgttcatcctcggcctcggcatcctgtgcagcgtcttcgacctggcctacatcgggctgctgctgcggccccgcctcacccgcctcagaagccttccggccccatcacgatgaccggcttcgcggccggatcgagggtctccaggaccttcttcatggccgccttcgggatgcccacacagccctgcgaggggccgtcgtggtccacgtgcagccagatgttgccgcccttgtcctcgccgtccggcatgaccgggtccagcggggaccggcccggcctgcggttgaagtcgatggcgacgacgtagtcgaaggagcccgccagggactccccgttcaccccgaggcccgaagggacgaagccgttgtcctcgtcgtacgggagccgggtccccggcggcttcggcagcagtccgcccgcgtcggtgagcgcgaagacacccatcggcgaggtcaggtccccgtacacccgctcggtggaccagccgttggccccgttgcgggccggccaggtctcggcccggacccagtcggcgccggccgcggggcgcgtgtagaaggcggcggtggactccgaggagtcgagcgccttgccggtgaccaggatgagctgacgggactcggcggggatccgggcccgggtctgctcactgacaccggtcaggccctgggcggcttgcctggcagcctgctcggcggcccgctgcgcggcccgccgggcgtcacgcgcggcccggtcctcggcctgcgggcgggcgtccgcgcgggcctgcggccgcggattgggggcctggtccgggtcctgggccgcatacacccagccggctgtgaaggtcgccaggccgagcacggcggcgagagccacccggggggacctgcggaccgcgcggggcttgccggacggacgggagcgggctcggacgtgcttgctcattcctccgaccgtacatcagcgggcccccgcagcccgggtggctgcgacgcgcgcgcccggctgatgtccgggaagcggacgcggaccgtcaggccgccctccgggtccggattggcccgcgccaccagctccgccccgtgcgcccgcgcgatcgacgccacgatcgacagccccaacccggccccctcacccgcggtgtgcagccgttcgccgcgcctgcggaagggctccagcagccccggcacgtccgccggatcgatcacggggccggtgttcgacaccgtcagttccccctcggccgaggtggacacggtgatccggccgtcggcgcggttgtggcgtaccgcgttggccagcaggttccgcagcagatgccccagcagggtccggtcgcccggcacggtcagcggcgcgagggtccgtacgacggtcagcccctgctgcggacacgccgccagctcggccgccgcgagcgccgccagatccaccggagcggtggactccagtccctgctccgagacggcgagcagcagcagggactcgatgaggtgctcgctggagtcggcgacaccgatcagcttggcgcggatccgggccaccttctccggcgacgggtcccccgccagaccgatctcggccgccgcccgctgcaccgcgagcggggtgcgcagctcgtgcgccgcgttcgccgcgaaccgccgctgcgccgagaccagctgctccatcctccccagcatcgcgtcgaaggtgtcggccagctgcttgagctcaccgggcggcgcgtcgagggagatccgctcgtccaggttctccccggacagacggcgcgcggtctcggtgatcacgccgacgggccgcagcacccggccggccatccaccaggcgagccagatcgacagcacggcgaagaccgccagcgccaggagggagtacatgagcagccggtgccgggtggcgtcggtgacggcgtcggagaggttctgggtgtacgcgtagcgctccagctgttcgatcgtgggggtctggcccgggggcagtttccgcgccggttcgcaggggcacgccggggtgatcctctcgccggggacggcccccggtgaggggacggcgtacgccggggagaccgtgcggacggccccgctgacgctcgcgtagaggccctggccgacgaggaggtagaccagcgccaccaggccgccgcccgccaggagcagcagggatccgtacagggcggtgaggcggccccgctcggtgcgcagcagccccgtcgacgggcgcccgctcaccgggccgcgatccggtagcccgcgcccggcacggtctcgatcagcggcggctcgcccagcttggcgcggagcttgctgagggtgacgcggacggcgttggtggagtagctggtgtcctgctcccacacctgctcgatcaggtcgtcgttgctgacgacggcgccctcggcccgcagcagcgcctccagcaccgcgaactccttgcgggacagggcgagccggtgcccgtcgcgggtggcgccgcgccgggccgtgtcgacggcgacgccggcgcgctccagtacgggcggcagcgcggggcgggcgcgccggcccagcgccaggacccgggcgaggagctcgtcgtaggcgaagggcttggtgaggtagtcgtcggcgccgaggccgagcccctccacgcggtcccgtacggtcccggaggcggtcagcatcaggacgcgggtcagcagccgctcgcgcacgacctgccggcagacctcgtcgccgtgcaggccgggcaggtcgcggtccaggacgaggacgtcgtactcgccgaggcgcaggcgccgcagggcctccagcccgtcgcccgcctcgtcgacggcgagcgcgtcgcggcgcagcccctcggcgatcatctcccggaggaattcctcgtcctccaccaccagtacgcgcatggcgtcctctttaccggagatcggtatttcgccgtcgtaagcagagtgcgagagggaagcgaaaggccctttcaccgcaggctcgggcccatgaagcgatccctgatcatgaccacggccgcggtcgtcaccgggctgaccctgttcgccaccgcctgcgcgaacgacgcgtcggcggggagggaggactcctccggcggtggcggggacggcacggtggccgacaacgccgtcaagatgcgccagtgcctgcgcgagaacggcatcgacgtgcccgaccccgagcccggacaggacccgcgcgggatgacgatcggcggggacgccgacccgcagaagatgcaggaggccatgaagaagtgcgggatgagcacgggcaccggcgccggcaaggagcccacgcaggaggagaaggacaaggagctggagtggatccggtgcatgcgcgagaacggcgtcgccctgaaggaccctgagtacaacggcggcatgaagagcgccaccgagatacccaaggggcaggagaaggccttcgaggaggccgtgaagaagtgcgaaacggcccgatgaggaagcgggccacgtggctgctgggctcgctggccaccgtactggccgtctggggcggcggctgggcggtcatggcgcagccgcagcgggacgcgggcgggcaggagcgcagcacggtcggcggactgccgccggccacggcaccggtcgtgcgcggcgacctcagcgcgggcctccaggtggagggcaccctcggctacgcgcgggagcgcaagctgaacgcggccgggcccggcgtgctgacgtggatcgcgggcgagggctcggcggtggagcgggacgggaagctgtacgaggtcaacggcaaggcggtgcggctcatgtacgggtccacaccgatgtaccggccgctgaaggccggcgacaagggcgaggacgtcaagcagctcaagcggaacctccaggcgctcgggtacgggaccgggctcgacccgcaggacggcgccttcaccgcgggcacggccacggcggtcaagcggtggcagaaggcgcacaaggcggcggagacgggcgaggtcgccaaggaggacatcgccttcgcctcggggccgcagcgggtgcgcggaggcgacgcggcggtcggtgacgagctggcgccgggcaagccggtgctgagggtgacgggcaccgagcggatcgtccgcttccggctggacgcggtgaaggcgggcgcggcgaaggcgggcgacccggtgaccgtacggctgccgggcggtaccagcgccaccgggaagatcgactcggtgggcggggccgcccggcccgacgacgggaacggcggagcgggcggcggcgggcagggcggcggcggagcgggcggcggcgacgacaaggcccggatcgaggtggtcgtcgccttcgaccagcccggcacggtgagcgccccggaccagtccccggtgaccgtcggcctgaccggcgagacccgcaagggcgtgctctccgtaccggtcaacgcgctgctcgcgctcgcgggcggcggcttcggcgtccaggtcgtcgaggacggccgggcccgcgaggtcccggtcgggctgggcatgttcggcaacggccgggtcgaggtgaccggcgacgccctcaaggagggcatgcaggtggggatcccgaagctgtgacggccacgacgacgacgcatccgcctgcgcatccggacccggtcgtggaactgaccggagtcaccaaggagtacccgggcggggtcgcggccctgcgcggggtcgacctgaccgtcaccgccggggaactcctcgccatcgtcggcccgtcgggctccggcaagtcgaccctgctgcacatcgtcggcaccctggaccgcccgacggcgggcggcgtacgcatcgccgggtacgacatcgcggccctcccggaccgtgcgctgtcggccctgcgctcccggcacgtcggcttcgtctttcagtccttccacctggtgccgggcatcagcgcccgggcgaacgtcgccgaggggctgctctacagcggtctcccgcgggccgaacggctgcgcctggcggcccgggcactggaccgggtgggcctcggcgaccggatggaccaccggccgcacgaactgtccggcggtcagaagcagcgcgtggcgatcgcccgggcggtggcgggcgcgccggacctgctgctggccgacgagccgacgggcgccctggacacggcgtccggggagtcggtgatggagctgctgcgcgagctgaaccgggacggcgccaccatcgcggtgatcacccacgaccaggagatcgcggcgagcctgccgcggcaggtacggatccgcgacggggaggtcgtcgcggacgtacgcggccgggcggaggggacgtcatgagccgcgcgaaaccccgtacgcgggcgcgcgcccggcggctgaccccgccgaggctgtccccgcgggacgtcctgcacgtcggatcggcgggcctgcgctcgcggccgacgcgggtgttcctgtccgcgctgggcatcgccatcggcatcgcgacgatgatcgcggtggtcgggatctcctcctccagccaggcgaagctgctgcgggagctcgacaggctcggtacgaacatgctggtcgcgaagccgggccaggggatgttcagcgggcaggacaccaagctgcccaaggacgccccgggcatgatctcccggatcgcgggggtcgagtcggtcggcaccacgggggacgtccccgagtccgtacgcaggtcggagaacatcccgaaaggggagacgggcgggatcgtgctcaaggcggccggagacgacctgccgggcaccctgcgcgcgcggatggcgagcggctcctggctcaacgccgcgaccggccgctacccctcggtggtgctcggggacgtctccgcgcgccggctcggcatcaccgcaccggggcagcaggtcttcatcggcggccggtacttcacggtgaccggcatcctggaaccggtcccgctggcgccggagatcgagcgctccgcgctgatcgggtgggacgcggccgagcagctgctgggcttcgacggccatccgacggcggtgtacgagcggtcggcggacgaccgggtggcggcggtccgcgcgctcatcccccggacggccaacccgcagaccccgagcgcggtgcaggtcaccgacccgtcggcggcgctccaggcgaaagcggccacggagggcgcgttcagcacgctgctgctggggctgggcgggatcgcactgctggtgggcggggtcggcgtcgccaacaccatgatcatctcggtgctggaacggcgccacgagatcggcctgcggcggtccctgggcggcacgaagggccagatccggatccagttcgtgacggagtccctgctgctgtccggcctcggcggcctggcgggcatcgccctgggcggcgcggccacggcggtctacgcccgggccggcgacctgccctgggtggtccccctctgggcggtgaccggcggcttcgccgccaccctgctgatcggcaccctggccgggctctacccggccgtccgcgcggcccggctgtcgccgacgctggcgctggcggcggcgtagcgaccggatccggcggggtgtccggcgccggggacggcgcccggggtcgggcccgggggacggacccgggggacgggcgggcaaacggcggtaaaaggccaggtgcaagcccatcccccggaaccgatcaccggcgtacattgaatcgatgatgcgaactccacgtcacgcagcgcgtgttgtcatcctgtcccccgccgggtccgtgttcctcttccgggaggacaacgtggaggtgggcatccactggctgccgcccggcggtggcatcgatcccggcgagagccccgaggactgcgtacggcgcgagctgcgcgaggagaccgggtggaccgacctggaacccgaacggctgctctgcacctgggagcacgacttcacgcaccaggggatcccggtccgccagcacgaacacatctacgtcaccacgggcccgcaccgcgaaccggtcctggagtccccggacatccactggcagtggctctcgccgcagcgcctggccaccctggccgaacccctgtggcccccgcgcctgccggacctcctggcgaacgccccgacggagccggtccacctgggactgctggcctgacgccgacgcggacgccggcctatgccgccggggtcttcgccgtggccttggcgtagagggaggccgcgtactcgccgaggaccgtgctggtcgacacgtcgtccgtctccccgcccgtgaggatgccgatgatctttccgtcgcgggcgatccacgcgctgccgctggtgccgcccgggaagtcggcgcagtcgaagcgctgctgggtgtcgctctcgcggaccgcgaccgacgtgcaggtacggggcaccttgcggtcggcggggtaaccggtgacggtgacctcctcgcccacgcggccgctcgtgtcgaggacggccccgccggtcacgtcctcgatggtgcggcccttgtcgtccggggcgaggcgggcgaaggcgaggtcgtagtcgtcgtccgtgccctcggcccagcggtcgtcctcgtagacctgctggatcttccatgtgccgtacggggcgaccccgttggcgtaggcgggggcgaagacggcgctcccgccgctctggtccccttcgagaaggcagtggccggccgtgatgatcaggttccggccggggctgctcaccacggtggcggtgcagaaatggtcactgtccaggccgttggtgaacagggccccggtgaaggcggcgggcccaccgggcggcggggtgacggccggcggcagggtggtggcgggcggcgcggagagctggggcttcgccgcttgcgatcgcgatggcgagggcgacccgctcggcgaggctcctggcgcggccttcgcccgtacctgcgggacctcttcgggcggcggcgccaacttggccaccgcggcggatgcccccagagccgccaccgcacacagcaccgcagtcacgacggtccgcttgtccaccggcatgatcatccttccgcttcgccctggcgaagcatgccccggcggcagggctggttgcaagaacggggacggcccgaggccccctcgtcagacgggtccgaccggcagctcgcacacgaaacccatgcccgggcggccgtccggatcgacctcgccggtgggcacgaatcccgtgcgggcgagcaccgcccgcgacccggcgttgtcgagcgtggtgacggcccgcagcgaggtcagtccgtaccgcgcgagagccagcccacagacttcccggaccgcggccgtcgccagaccccggcccgtggcccgctcggcgatccggtagccgagctcggccgaaccgtccgccacgtccaccaggttgacccggcccaccacctcaccgccgtcgcccaccagtacgtggaagaagcacagcccggtggcctgctcggccaacagcgcggcgtgccgctcgtcgaagtcggcgaagtagcgatcgccccggtccgggacggccgcggcgaagtaggcgcggttctcccgctcgaacgcgagcagggccggggcgtggtcgaggcggagcaactggagccggggcaccgctcgatgctacgcactgtcggcccgacaggccccacaggccccacaggccccacaggccccacaggcccgacaggcccgacaggcccgacaggcccgataggccccggcgaagcctccggggagtcccggtgcgccgtataggtcgtctgcccgatccccggcccccgccttagaacacaggctgagcgggtgatcgatcgaggcatggggaaggtcctgcgggaccgcgacgcgcggctctacctgtccggggtggtggtctccggcttcgggacgaccgcgatgtggctggtggccggggtctgggtgaagtcactgaccgggtcggacgcgctcgcggcactgaccgtgttcaccatgtgggcgccggtcctggccgggccggccctgggggcgctcgccgaccggctgccccggcggccgctgctggtcgccctcggcctcgtgatggccgccctgctgcccgtactgctcctggtcgactcggcggaccgggtgtggctgctgttcgcggtactgctcgtgtacgggacgtgcggcaccgtgcacggggcggcggaggcggccctggttccgcgggtcgtgggcgggcggctcctgggggacttcaacgggctgcggctgacggccgacgagggcatgaaactcctggcgccgctggtgggcgcggccctgttcgcacggtccggcggggcttcggtggccctgctcgacgcggtgaccttcgccctggctgcggggatcttcgccctgctgcgggtacgcgaggaacccccggcgcgcgagcggatccgggacgacgcgggcaccttcgcgcggatggcggcgggcggggtgcagctgtggcgggtgccggtggtgcgcacgctggtggcggccggcgccgccgtgatgttcctggccggactgaacggcgcgatggtctacgcggtcgccggggacgtactggggcacgcgcccacctacgtgggggtgctgtacgcggtgcagggcgcgggttcggtcctgagcgggctcgtggcgggcccgctgctgcggaggatgccggagccggtgttcgcggcggccggagtggcgctgttcgccctgggcgccggggcccgcgcgctgccgtacgacgcggtggccctggcgggcagcgcggccgtcggcgccgggctgccgtgcgtactgatcgccgcgctgacggcggtgcagcgcgaggtcccggacgacgtgctgggccgcgccgcggccacggcgaacaccctgatcttcgtaccgaatgcgctggccctggcgctgggcgcggcgctggtggccttcgcggacgtacgggtgctgctgccggtgctgacggtggcggggctggccacggcgctgctggtgtcgcgggcgcgggcgggcgcgcgggcgggcgcggatgcccgtagggcgtgaccggccggaggagccgggcgggccacgccctacgggcacggcgtacgcgtgcgagcacggtgtacgcgtacgggacggcgaccgccaccgctgccgatggccggctcacgcgcgccggctcaggcccccgggcccgcccacaggccgtccgccgtgagtccgagcaggtcgatcgcgttgccgcgcacgatgcggtccaccacgtccggcgccaagtggcccatctgggcctcgccgacctcgcgggacttgggccaggtcgagtcggagtgcgggtagtccgtctcgtagaggacgttggcgacgccgatcgagtcgaggttcttcaggccgaaggcgtcgtcgaagaagcagccgaagacgtgctcggcgaagagctccgacggcgggcgcagcaccttgtccgcgactccgccccagccgcggttctcctcccagaccacgttcgcgcgttccaggatgtacgggatccagccgatctggccctccgcgtacatgatcttcaggttggggaagcgctcgaacttgccgctcatcagccagtcgaccatcgagaagcagcagttggcgaaggtgatggtggagccgaccgcgggcggggcgtcggccgaggtggacggcatgcgggaggaggagccgatgtgcatggcgatgaccgtgccggtctcgttgcacgcctccaggaaggggtcccactcgtccgtgtggacggaggggaggcccaggtgcgggggtatctcggagaaggcgaccgcgcgcaccccgcgcgccgcgttgcggcggacctcggcggcggcgaggcgggcgtcccagagggggatcagggtgagggggatgaggcggccgccggcgtcggggccgcaccactcctccaccatccagtcgttgtaggcccgtacgccgaggagtcccagttcacggtccttggcctcggtgaaggtctggccgcagaagcgggggaacgtggggaagcagagggccgactggacgtggttgacgtccatgtccgcgagccggtcgggaaccgagaaggacccggggcgcatctgctcgtaggtgatgacttccagtttgatctcgtcgcggtcgtacccgaccgcggtgtcgaggcgggtgagcggccggtgcaggtcctcgtagacccaccagtcgccgatggggccgtcgtcgcccttggctcccatcacgggcgcgaacttgccgccgaggaaggtcatttccttcaagggggcgcggacgacgcggggaccgatgtcgcggtatctggacgggagacggtcccgccagacgtggggaggttcaaccgtgtggtcgtccaccgagatgatcttcgggaaggtctccatgacgcatacggtagcgccgatctgacgaaccgtcagctagttgggctgtgatcggtcatgtacgggctgacgtgtacgcgcgagacagggcagactgacccttacaccgaacggaaggcagggggacgacagatggacggcgtaccggccatcccgagcccgcggaaacatcccgaggcccgtacggctgccgccgcacccgaggtcggtccgggggcgccccccgcccgcgcgacccccgcacccgcggccggcgccccgaccaccgacaccgccgcggtcacggccgccgcggccggaaccggaaccggagccggaaccatcaccgacacggccgacaccgccggcgccaccggccccggcgagttccgcttcgccgtcctcgggcccgtccgcgcctggcgaggcggcgagctcctgccctccggcaccccccagcagcgcgccctgctcgccgtactcctgctgcgcgacggccgcaccgccaccgcgcccgaactcatcgacgccatatggggcgaggacccgccgcagcaagccctggccaccatccgcacgtacgcctcccgcctgcgcaaggtcgtcgcccccggcctcctcgtcaccgagtccggcggctacgccatccggctgcgctccgccgccaccctcgacctcggcgtcgcccgcagcctcgccgccgacgccgaaacggcccggaccgccggtgaccgcaccctcgcccggacgctcctggcccgcgccctcgacctctgggagggtgagcccctcgccggcatccccggcccgcacgccgagaccgagcgcatccggctcgccgaatggcgcctccagctgctggagacccgcctcgacctcgacctggaggtcggccaccacgccgaggccgtctccgagctcaccgccctcaccgccgcccacccgctgcgcgaacgcctgcgcgagctgctgatgctcgccctctaccgcagcggccggcaggccgaggccctcgccgtctacgccgacacccgccgcctcctcgccgacgagctcggcgtcgacccgcgccccgaactggccgcgctccagcagcgcatcctcaacgccgatgccgatctcgcccgcgcggaggacccggccccggccgccgcgaccgtccacgtgaggcccgcccaattgcctgcgaccgtccccgacttcaccggccgcgccagcttcgtcgccgaactcggcgccatcctcggcggcggcgccctggaccaggtcatggccgtctccgcgctcgccggcatcggcggcgtcggcaagaccaccctcgccgtgcacgtggcccacgccgcccgcccgcacttccccgacggccagctctacgtcgacctccagggcaccgaggcccgccccgccgaaccggaggccgtcctcggctccttcctgcgcgccctcggcacccccgacacggccatccccgactcgcccgccgagcgggccgcgctctaccgctccatcctcgacggccgccgcgtcctggtcctcctcgacaacgcccgtgacgccgcccaggtccgcccgctgctgccgggcaccgccggctgcgccgccctcgtcaccagccgggtccgcatggcgggcctcgccggcgcccatctcgtcgacctcgacgtgatgagccccgaggaggcactccagctcttcacccggatcgtcggcgaggaacgcgtacgcgccgagcgccaggccgccctcgacgtcgtgggcgcctgcggcttcctgccgctggccatccgcatcgccgcctcccggctcgccgcccgccgcacctggaccgtgtccgtcctggccgccaagctcgccgacgagcgccgccgcctcgacgagctccagaccggcgacctcgccgtcaaggccaccttcgagctcggctacggccagctggagcccgcccagcagcgcgccttccgcctcctcggactcgccgacgggcccgacatctccctctcggcggcagcggccgtgctcgaccttcccgagtacgacaccgaggacctcctggaggccttagtcgactgttccctgctggaatccgccgctcccggccgctaccgcttccacgacctcgtacgcctctacgcgcgtgcctgcgccgagcgcgacgagcagccgcccagcgggcgcgaggcggccctggaccggctgctggacttctacctggccaccgcctccggggtctacgccctggaacgcccgggcgaccggctgcccgcgcacctgtccgacacccactaccccgggctggtgttcgccgagccgcgcgccgccctggactggctgtacgccgaggccgacccgctgctggcgtgcgtacggcaggcctccgtacggggcggcgagtcactggtcctgcgccgggccgtggacctgctgtgggcggccaaggacctcgccgagtccggggccaactcccggcagtacgagtcggccgcggtcgccctgcgcgacgccggccaggccgcgaaggacccgtacgccgagggccgcgcccgcaccaccctcaccaacgtccacctggtcgcgggccgcttcgccgaggccgacgacgaggccgcgcgggccaccgtgctcgcccgggaggccggcgacccgctgcccatgtgctgggcccccaacgaccgggggatcatcgcgctgtacgagggccggcacgcggacggcgagcgctacctgctgcaggccatcgagtgcttccgcgccgacggcaacaacgtcggcgaggccagcgccctgtgcaacctctcccgcatccatgtggaactgggccgcctgcccagcgccatagacctggcccagcagggcatcgccatctacgaccggatgggcctgagcctgcgcctggccaacggccgctacgcgctcggcatcgccctcacccaggcggggcggctcggcgaggccctggcgcagctcgccgaggcgctgtcgctgttccacgagaaccgccagccgctgtgggagggcgtgacccacttccggctcgccgaggcccacctggcggcgcgccggcccaccctggccgcctcgcacgccgagcaggcgatcgcgctgcgcggcatcggcggggagtggcgccgggcgacggtcctgacggtgctcggcaaggcgctgcggcggctggggcagcgggaccgcgcgcgggcgtgctggcgggacgcggaggcggtgttcacgcagctgaggtcggccgaactgggcgaggtgcaggccctgctggcctcggagatcgctgcctgagctgcgacggaaccggatgaacacggcgttcatcgttcgtttatcgccgtccgacacgataagtgcatcgacccggcgcctcgggggagcatccgggtcggttggtggactacccgttcggcggtcatcgggggaatcgccgaacgggcccagccctaaaccatcaggagaatcgatgacgacgaacgagaacctcaagccgctcgacaaccacgcctcgggcgtcgagatcgagaccctggacaaccacgcctcgggcatcgagatcaagccgctcgagaaggagccggctccggccgtccccaccacggacgaggagatccagacgctggacaaccacgcgtccggtccgcgcccgtagcacgcgcaagacgtacgggggactccacgggggagtacgggggaagtacggcggtcgcggtggcccggagggggagccaccgcggccgccgtacacgtatgtgcgggcacgggcggcataggctgggagcgtgttctcctcccacgggccgagcgtccgcgaactggcagtgcagggcctctcctcggtggagcggggctacgacctcctcgcgccgaagttcgaccacacccccttccgcaccccggaccggatgctcgacgccgtcgaggagaccctggcccatgtggagggcggcttcggggccggcctggacgtgtgctgcggcacgggtgccgggatcgacatgctgcgccggctgtgccgcgaccggatcaccggggtggacctgagcgcgggcatgctcgcgcaggccgagcgccggtacgccgcggacgccgaccgcgtggacttcgtacgggccgacgcgcgggccctgccggcctccctcgcggaccgctacgacctggcggtcagcttcggcgccttcggccacttcctcccgaaggaacggcccgcgctcttctccggcgtccacgcggccctgcgcgagggcggcgtcttcgccttcccgatcggcgccccgctgccgctcggctcccgggtgtggtgggcgacgacgggcttcgacgcggcgatgcgggtgcgcaacgcggtgtggcgccccccgttcgtcatgtactaccgcaccttcccgctgggcccggtcggcgaagacctgagggcggccggcttcacggtggagacggtccccctcccccacttcggccaccgcccggacggcaccccgaactggcgcctggtcctggcccgccgccgctaggccgttccccggtacgcgagggcgccgccgaataggctgaaccagcgcacccctggaggacaccatggccgccgagctccccgaatggatgctcccgccccgcccgagcggctgggaagcggacgacctcgatcacctgccccaggctccccggcacaccgagctcatcgacggagcgctgatcttcatggtgtccccacagcggtcctggcactcccggctcgtggagaacctgaccttcgccctgcggcaggcagcacctgaaggcatcgagatcgaacgggagatgaccgtacggctcgaccggaagagccgtccggaaccggacatcctggctgcggccgtcccctacgacccggaccggacccgctacctccccgacgaggtggttctggtgatcgaagtggtgtccgaggagtcggtggaccgcgaccgttccatcaagcccttcaaatacgcccaggcgggaatcccccacttctggcgtgtcgaggacgagacgaccgggcccgccgtccacgtctacgagctggacaccgtcacccggtcgtacgtcgcgaccggaatccaccgggagtggctcaaggtggcggttccgttcgctgcgaccatcgatctgggcggcctcgtcccctgatccgcctcagccggtgcgcagggcgcgtttgaggattttgccgctcgcgttgcgcgggagttccgtcacgaactcgaccgcgcgcggcaccttgtagttggccatctcgcggcgcgaccaggcgatcaggtcgtccgcggtgacggtggagccggggcggcggaccgcgtaggccttgccgacctcgcccagccgggggtccgggatgccgatcaccgcgacgtccgcgatgtccgggtggaggccgaggagctgctcgatctcggcggggtaggcgttgaacccgccgacgatgaacatgtccttgatccggtcggtgatccgaaggttgccgtcctcgtccaggacccccacgtcgccggtgtgcagccagccctcgggggtgatcgtcctggtggtctcctcggggtcctcgaaatagccctgcatgacgtggtagccgcggaccgcgatctcgcccgcgcgcccggccggctgcggccgcccgtccgcgtccaggatcaccacctccgtgtccgggatggcccgccccgaggtggcggagacggtctccgccgcgtcgccccgccggcacatggtgacgatgccgctggcctcggagagcccgtacgccgtgaggacggtcgcgatgtgcagctcgccgcgcagccgttcgacgagccgcagcgggaccacggccgcgccggtgacgaccaggcgcagggcggacaggtcgtggtggtcgcgctgcgggtggtccaggagcgactggtggagggtgggcggccccgggagtacggagatccgctcggcggcgacgttcgcgaggacggtgtccacgttgaacaccggctgcggcaccatcgtggccccgcgcatcaggcaggcgatgatcccggccttgtagccgaaggtgtggaagaaggggttcacgatcaggtagcggtcgccctcgcgcaggccggcgagctcgctccacacgtcgtagcagcgcagggactggccatgggtgatgaccgcgcccttgggactgccggtggtgccggaggtgaagatgatgtcggagggggactcgggtcggatggcctcggcgcgctcgcggaccgccgcggccggtacgccgtccccgcccgccaggaagtccttccaggtgcggaaggagtcgggggcgtcgtcggcgaggacgacgacctgctccaggtgcgggagcccgggcagcgggccgccgccggggccctcggccgccgcgcggcgcagggaggcgacgtaggaggtgccgaggaaggtgccggtgacgaagagcagccgggcccggctccgctccaggacgtaggcggcctccgtgcccttgaaacgggtgttgagggggacgagcaccgcgccggccgagacggcgccgagggcggagacgatccactccagggtgttgggggcccagacagcgacccggtcgccgggttcgatcccggcggcgacgcaggcggcggcggcccgctcgacgcgctcgccgagctgcgcgtaactgatccgggtgcgcccgtcgacgacggcctcgcggtccgcgtaccgtgccgccgccgaccggacgagctgcgcgatgctgccccagcgcagatccccgcgtccgtcctcgtgccggtcgtcgcgcgtgtcgccgtgcccgtcgccgtgcccgtcgccgcccatgcgtgccaccttcccgcagacccagtagctgactatccgtcagattagctgtagccttcgcggctgtcagtactggcgcaccccggaggtggcgatggcggcaacgctcaaggacgcgacggcgatagtcggcatcgggcagaccgcctttgccaaacaactgccgcagtccgagaaggagctggcctgccgggccatcctcgcggccctcgccgacgccggcatcgaaccgtccgaggtcgacgccttcgcctcctacaccatggaggagaccgacgaggtcgaggtcgccaaggccatcggcgccggcgacgtcaccttcttctccaagatcggctacggcggcggcggttcctgcgccaccgtcggccacctcgcctccgccgtcgccaccggccaggccaccgtcggcgtcgcctggcgctcccgcaaacgcggctcgggcccccgcccctggaagaacaccgccgtccagctgcccacccccggccagtggacccgccccttcggcctgctgcggcccgccgacgagatcggcatgctcgcccgccgctacatgcacgagtacggcgccacccgcgaccacctgttcaacgtcgccatggcctgccgcaaccgcgccaacgagaacccggcagcgatgatgtacgagcgcccgctgacccgcgagatgtacatgacctcccgcatgatcagcgacccgctctgcctcttcgacaactgcctggagaccgacggcgcgctggcctgcgtgatcgtctccgccgagcgcgcccgcgactgccgccacaagcccgtctacgtccactccgtcgcccagggcctgccctcccagcaccacggcatggtcaactactggaacgacgacccgctgtccgggcccgcctggaccgccgcccgccacctgtggaagcaggccgacttcgggccccaggacgtcgacgtcgcccagatctacgacgccttcacccccctgatcccgctctccctggagggctacggcttctgcggccgcggcgagggtgccgccttcaccgagggcggcgccctggagaggggcggccggctccccatcaacaccgggggcggcggcctgtccgaggcgtacgtacacggtttcaacctgatcaacgagggcgtcaagcagctgcgcggcatctccaccgcccaggtgccggacgccgcgacctgcctggtgacggcgggcgagggagtcccgacgtccgcgatcctgctgaggagctgacccgatgaccaccacgcccgcagccgccgacgaactcctcctcccggtccccgacgaggacggcgcccccttctgggagtacgccgcccggggcgagctccgcgtccaggcctgcgccgcctgcggccggctgcgcttcccgccccggccctgctgcccgcactgccggtccttcgacagcgagtggcgccgtatgagcggccgcggccgcatctggtcctacgttcgcccgcacccgccgctgctgcccgcgtacgccgcgcaggccccgtacaacgtgatcctcgtggagctcgccgacgccccccacatccggctcgccgggaacctggtcacctccgccgacgccccgctcgactcggtggacccggcccggctgcggatcggcgcccgcgtgcacgtggtcttcaccgagacgggcggcatgaccgtgccccgctggatgctggagaagtcatgaccgtgcgggtggaacgggacaaggagaccggtgtcgcggtcgtcaccctggaccgggagcaccggcacaacgccgtagacctggagaccgccgcggaactgggcgcggtgtggcgggagttgcggttcgacgaggaggtgcgggccgtggtgctgaccggcgccggtacggccgccttctgcaccggcatcgaccggggcgtcgacgtgccgcagcccgcctccccctactccgccgacgatccgctgatcgccatcggccccaaggcgggcgacctgtggaagccggtcgtcgccgccgtcaacggcatggcctgcggcggggccttctacctgctgggcgaggcagagttcctgatcgcctccgagaccgccaccttcttcgacccgcacaccacctacggcatggtcagcgcgtacgaggccgtctacatggcccagcggatgcccttcggcgaggcggcccggatgtccctgatgggcacggccgaacggctctccgcgcgccgcgcccacgagatcgggctcgtctcggagctgaccgcgcccggggaactgctcccggcggccctgcgggcggcgcagaccctggccggcttcccgacggaggccgtgcagggcaccgtacgggccctgtggtcggcgaagcaggccgcgctccagcaggccctggcccaggccccggcgctgatcgcgctggggaacctggcgccggaacggcaggcggagctgttcgcctcacggcggcccggtacggagttcaggctgcgctgagggcgggcctcagggcttgcgcgtggacttcgggccgggcttcttcggggtggacccgggcgtggagccgggcgtgctcccgggcgtggagccggagccgcccgaggtggtcccggccgagcccgtcgtcgagctgccggacgtctgccggagccggtcgaggcggcacgtggtgacctcggccgcgcgcgcgggctcctggagcgcgacctcgaccgtacgggtctcacgggcctccagggtcgccttgacctcggtggactcgacggtggtgccgttcgcgccctcccggtacagggtcaccgcgaaggtcgccttgcggtccgcgttcgaggtgaacctgacggtggtgaccggtggggtggcgccgacgcaggtgaccacgacggccgtggccggggcgccgctcggacttgccgagggcgacgcggaggccgtgccgttgccgttgttgctgccgccgtggcccttcttcttgctcttggagctggagcatccgccaccgctgctgctcttgctcttgctcttgccgccgctgctgccgccgtgcgacgagaacccggtcagcgcgagcaccacgcccaccagcaccgcggtgaacctgatacgacgtccagccaccatggcccgaacccctccccgtggacaacggcgggccacgctaccagccgggacgcgccacgtaagggggacataaagactctgcgccgcggcacaggcaacggctgcgcgaacgaccctcggcgcaacccccgccgatagcccgagcaaaccgaacaggaaagccgaaaccatcccactcgccctgtacaccaaggccaactgggctttcactgcgccgcattgccagaccgccatgcaagaattcgcacaagcgtctgagaatgttcactaccacgggggggtgggcgcgtggctgtcacggtgcctgactgggcggacacactgctggatctgatcggtgtggcctggccgaacgtggacgaggacgcctaccgggccatggccgactcgctccgcgagttcgccgaggacctgttggacgacggccagctcgccaacaaccacgtcgagcgcctgctctcggcgagcaagggcgagtcgatcgaggccctcaacaagcactggaacaccgtaaagaccaagcatttcaaggacattgccgaggcggcccgcaccatcgccggagcgatggacatggcggccggggccgtcgagggcatgaagtacgcggctctcgtccagttgggctatctcgccgccgaagccggtatagccctctccctcatcccggtcaccgccggcctctccgccctgttcggcgcggcggcgatgcgtctgacccaggaagtcgtgaagcggctcatcaaggagtgcgtcgaggaggccgtcggctacatcgtctccgcgatgaccgaaccggccgtcgccgccctggaagggatggccgccgacctcgtcgtccagctcggctcgatggccctcggcttccaggacggcgtcgacctcgaccagaccaagaacgccggaaaggacggattcaacgacggcgtccagtccggcaaggaagccctccacctcgcctccgcaggcagcggctccggcgggggaggcaccggcctgaccgacctgcacatcgagcacagcgagcacgaccgcgccggcactcacctcaacgccgtcagcaccggcatccacggcaagaccagctcgaagctgaccaaggccaagtcccaccacggccgcaccagaggccgcgactccatcgctcaggccatcgaccccgtcgcggacaaagccctcgccgccctcaccaaagccaccaaagccatgggcgaccatgtcggtaccaccctcccccgagccgtcaagcagatatccaccgaccacaagaagaacgaccaagccctccacgacgacttcaaccgtctgaagaaggacggtggcaacaacaagggcgggaacgacggtcgcggttccgacggccgggacgcgagcagccgcacgaagcccgactcgttgcacaaggccaaggacgagccccgccgcaacggcatttcgctcgagaagaagcggtgcgagaacgaccccatcgatgtcgtcaccggcgagatgacactgccgcagacggacctcgcgctgcccggcacccttccgctcgtcctcaagcgcacgcacctgtccgggtaccgctacggccagtggttcggacgaagttgggcctccacccttgatgagcgactggagagcgacgcgctcggcggcggcctgatctgggcccgtgaggacggctcccttctcgtctacccccggttcccacaggcaggcgacgacccggtcctgccgctcgagggcccgcggctcgccctcacccacggcggtcagtacgacgacgagacgacctacaccgtcaccgacactcggtccgggctgacgaagtccttcaccggcagcccgtacagcgcctccacggcgtactggctgaccaggatcgaagaccgcaatgacaacgtcatcgccttcgcccgggccaccgacggagcccccaccaccgtctcgcacagcggcggctacaccgtccggctcaccacggacgaccagcggatcaacgccatggacttgcgtaccggggacgggcccgtcaccgtcatggcgtacggctacgacgagtccggaaacctcaccaccgtcgccgactcctccggtcgggctcagcgtctgacctacgacgagcacgcccgcatcacgtcgtggaccgaccgcaacgactccaccttccgctattcctacgactctgccggccgggtcgtacgcaccacgggccccgacggcttcctctcctccgccttcgagtacgacagcgcttccggaaccacccgctacaccgactccacgggcgcggccactgtcttccggttcaacgaccacctccaggtcatcgccgagaccgacccgctcggccacacggtccgtcggctctgggacccgtacgaccgcctgctcgcccagaccgacccgctcggccggaccacgacgtacacctatgacgggcgaggcgacctcgtgcgcatcgtccacccggacggcggcacggccacggtcgagtacaacgaccagcaccagctcacctccgtcaccggccccgacggctcgacgtcccgccaggagtacgacgaccgaggaaacccgactctcttcacccgcccgaacggcacgacaacccggctcgcccacaacgcatcgggccacctgaccggcgtggaccattccgacgacacgtcggaccgcctggtctgcgacgcggccggcctcccactggccgtccgaggtccgtcgggcgtgatcacaacgtacgagcgggacgccttcggccgccctacccggatctccgatcctcacggccgcgccacacagctggagtggacggtcgagggcaaaccgacgcggcgtaccgactccgacggatccacccagtcctggacgtacgacggtgaggggaactgcctcacccacgtggacgcggcgggaggcgagtcccgcttcgagtacacccacttcgacctggtcacagcccgcatcacaccggagggagctcgccactccttcgcgtacgacacagaactgcgcctcactcaggtcaccgatcctgccggctcgtcctggacctacacgcgtgacgcagccggacgcctcacgtccgagacggacttcgacggccgtgtcatgcgctatacccacgacgcgatcggtcggctgaccagccgcaccaatggcatcggccagacggtccaatacgagcgcgactccgacggccgagtggtggtcaaggacgccgaaggcgtactcacccgcttcacctacgacgcttccggccgcctggaacgggctgtcggccccgacgcggagctgctgtacgtgcgggaccgtgcggggaggatccttcgcgagctgtgcaacggccgcgagctcacccacacccatgacgaggccggccgccggatccgccgcaccactccgaccggagcggtcagctcctgggccttccccggagatcgcagcgccctgctcaacgcctcgggccgccaggtgaccttcgagttcgacgaggcgggccgcgaaaccattcgccgcatcggcgaaacgctgaccatcgcccacgcgtacgacgaccaggggcgcctgacggaccagcaggtccgggccgacgacgaccggactgtccagcaccgcgtctacggctaccgtccggacggccacctgaccacggtcgacgaccacctcgccggccgacgccggttcgatctgacccgcgagggccgggtcacgggtgtgaccgccgcgaactggagcgagcagtacgcctacgacgcgtccgggaaccagaccgaggcctcatggcctacggacgacagcgccgcgggtccccgcacgtacgtgggcacccgcctcacaggggcaggttcggtccgctacgaacatgacgcacaggggcgggtggtcctgcggcagaagcgccgtctctcgcgcaagccggaaacctggcgctacggctgggacgcggaagaccgactcgtctcggtcgacaccccggacggcagtcgctggcggtacctgtacgacgcgctgggccggcgcatcgcgaagcagcgcctgtcggcggattcgtcgtcggtcgccgaggaagtgacgttcacctgggacggcgacaccctcatcgagcaggtgacccacacccacggctcccgggagaccgtcgcactgacgtgggaccacgacggcgtgaagccggtcacccaggtggaacgccgcctgctggaccaggcggagatcgacagccgcttcttcgccatcgccacggatctgatcggaacacctcgcgagctcgtcgacgagcagggcaacgtggcctggcacacgcgcaccacgctctggggcatcaccacctggaaccgggacgcgacggcctacactccgctccgcttccccggccagtacttcgacccggagtcggagctccactacaaccggcaccgccactacgacccggcttccggccggtacgtctccccggaccccctcggtctgaccccggcgcccaacgccttcgcgtacgtcgacaacccgacgacgtggatcgacccgctgggcctggcgatgtgcccgcacagcaagaatacggagcaccggcacagcgtggtgctgggtccgaacgtcgcccccgatgaccagtccaacagtctggccaggtatctgcggaacgacccgaacgaccctgagtaccacgacccgaccagaccacgggatcctggggcccacacgtacaacggttccgcctacgcagcgtcggaggcaggcggtccggtctggatgaccaatgtcatgagcgcggtcaacgatcgaggcacgacgttgtcgatcacccttgacgggatgccgaacagttccggccgggtaggcaactggaatacgcccgaagacatcgtggacgccttccagacagcggctcggcacggcgcacaattcaacaccctgcacgaggacaactatcctctccgaggcgatggaacggcatgggagatgagccaggtcgcgctcgccgtcacccagcatgacggagccgccgcctggggtgatgcggaccacgagcgtcccggacgcccctgggaggagatccactggtactcggagaaccagcggatccacgtacccaaaccggatatcccggagatcaccccagacctctcggcgctgcacaagaagaagtgatgtcaccgcatgacgaacgatgaagtttccccggccgcggcggagatcgtggcgcgctcatggcagaccgtcctggactacggtccggaccggatcgatcccgccgtgcctcgtgccgcgtacggccatccggcactgcgggagctgttccccgcggtcagccacggtgtgctgtacctcagccggtgcatccggtacccgtggacccgggacatcggtaccgccttcccgcaggccgccggcggctaccgcgtacgaaggcagtccgacagcaccctgctcggcgtgacggagacggcggaggaggcctaccgcctgatcgcggcgcacctccccgaggactgcggcccggcgatcgacggcaccgcgaacgacctgtgaggccgcctcggcgaacggcacggggcgcctgacggcccccggacatggcggcggccccggcccccggagggggcggggccgaccggccgggctggcggggtggggtcaggcggcgtcgacgacgccggaggccgcgatctcgaccttgcccttgggggcgccggactgggagcccagggcctcgatctggtccacgagctcctggcccgagacgacctcgccgaagacgacgtgcttgccgtcgagccacgaggtgacgacggtggtgatgaagaactgcgagccgttggtgttgcggccggcgttcgccatcgacagcaggtacgggcggtcgtgcttcagcttgaagttctcgtcctcgaacttctcgccgtagatggacttgccgccggtgccgttgtggttggtgaagtcaccgccctgcagcatgaactgcgggatgacgcggtggaagcccgagccggcgtagccgtagccgttctggccggtgcacagctcccggaagttctgcgcggtcttcgggacgacctcgtcgaagaggttgaagacgatgcggccggcgggggcgccgttgatggtgatgtcgaagtagacgttgctcatggggtccatcctgtcactcccggtgcggtgcgctacccggcggggccgcagccccgcctccgcgcaggtcaaccgctcgtacgggtgcccgtgcccttcgccgcgtccagggcgtacacgcagcggtccttgctgcacgcgtagaccacgcccgcctccgccaccggggcacccgtgatctcaccgcccgtggccagcttccagcgcagctggccgcccgccgcgtccagcgtgtacaggcagtggtcggccgaaccgaagtgcacccggccgtccgccaccgccggcaggccggtgatctcgccacccgccgcgaaccgccacttcggggtgccggtgaccgcgtcgagcgtgtacagggcgctgcccgcgcccaggtggacgttgccgctcacgaccaccaccgggtccgcggactgccgtgcctccgtcgcgatccgccagcggtcctggccggtggccgcgtcgagggcgtagaccgtgcccaggtagtccacgaggtacaccccgccgccggtgacggccgcgcccggcgcgaaggccgggggcgccaggaagaccgcgggggcctcgaagtgccagcggacccggcccgaggcccggtccaccgagatgacccgggtgccggccgcgacgtagacgttgccgtccggggccggagtgacccggacgggtacgttcccgcaggaggccgcgtcaccgatcggataggaccaggactcgcggccggtgcgcgcgtccagggcgcgcagccgcgcgtcctgccacacgtacaccgtgccgtcgtggaggacgggggccgcctccggggtctcgaagtcgctctgcgcgccggtcagctcccacagcttgtggccgttggaggcctcccggccctgtacgccgccgccgcgcgtggcggtgacgaccgtgccgcgctcggcgcgcagcgcgtacacccaggcgtcggtggacagccgccaccgctcggagccgtccccggcgtcgagcgcgtagagggaggggccgtcggacgcgtggatccggccgtcggcgaccgccatggaccaggcgacgtcgcgggtcttgaactggcggcggccgctcgccacgtccagcgcgtggacctcgaaggaggtcacgtagagcaggttcccggcgacggtcggagtgccccagacctcgttggacatgcggaagcgccacggccgccagcggccgctgtccggggccgggccggggcccggtacggagcccggtacgggctgcaccgccgacggggcggccaccgacccgcccggcgggcggatccagccggtcgccgagtccggggcggaggacgaggcgtgcgcggccggcgccgaggtgctcgcacgcggcccgggcccgatcggcaccggcgacccgcccaggcgcaccggctcacccgagggcaccggggacatcggcgggtggtgcgggcgctgcgggacggcctggccggtacgcgggtccacccacgagtcggccccgcgcgggcggcggtgcgtggcggcctcggagcccgacccgcggcccccggagcccgagccgggcgccggcaccgcggggacgggcacgggcggcgtacggtgccccgcgcgccgggcctcgatcatcgcgacggcccgggcgggcagccacgccgaggccgtaccgctgtcgtcgccgccgtcgaacaggtgcggcgcgagctgcgcctgcaggtcggcgggggtgggccgcagcgtggcgtccatctgcatgcaggagtcgatcagcggccgcagctcggcgggcagcccctccaggttggggccctcgcgcagcagcatgaagaccgtctccaccgggttcgccccgtggtacggcgggtgcccggtggcggcgaagacgagggtggagccgagcgagaagacatcgctggcgcccttgacgctgcgcgagtccttggcctgctcgggcgacatgtaggcgggggtgccgacggcgacgttcgtcatggtcagccgggtgttggagaccccgctcgcgatgccgaagtcgatcacgcgcgggccgtcctcgacgacgagcacgttggacggcttcaggtcgcggtggaccaggccggcgccgtggatggactgcagggcctcggcgatgccggccgcgagccaccgtacggcctgggcgggcatcggcccgcactcgttgacgatctcctccagggagggcgccgggacgtacgcggtggccagccacggcacggcggcacgcgggtccgcgtcgaccacggccgccgtgtagaagccggacacggcacgggccgcctccacctcacgcgtgaagcggacccggaagagctggtcctcggcgagctcggtgcgcaccgtcttgatcgcgacccgccgtccggacgcggaccgcgcgagatagaccagccccatgccgccggcgccgagccgtcccagcacctcgaaggggccgatccgtctcgggtcgtgctgcgtcagctgctccaccactcgcctccacacctccccgtacgggccactcagcgggcccgcttccaccggcacggggccctgccccgtgcagcgtctcactccgggcgccgcccgggtcgagcaaccccgattctgtcaggcccggacccggtccggccccggcacgtcgagcagggcggtgtgatctgctcggcgatcttcccgggagggcggcggcgcgggcttcccggcctggtgggcggggttacgcggccggcttggtccggggttccgagagcagcccgaagaccgccccctggttgtcggcgacgaccgcgatcctcccgtagggggtgtcgaaggggtcggcggtgacccggccgccgagccgctgcaccatggcgaccgactggtcgcagtccggtacggcgaagtaggcgaggaagtgcgcgggcatggcttcggggaaggcgtcggtgatcaggctgcggccgaggacggcggtgtccgtgccgggcgcggttccgggcggggaccagatgcggtactcgacgccggcgtcgtcctggtcctgcgggacgtagccgaagaccttggcgtagaagacgtcgacggcgtcgcgggcccgggtgtagacctcgctccagcagtacgtgtacggctcctgctgggcgtcgaagccgtggtgggtgccgggctgccacaggccgaagacggcgccgccggggtcggcggccatcgccgcggtgccgtacgggccgaccggcatcgggtccatcaccatctggcctccggcggctcggatgcgctgcgcgcaggcgtaggcgtcggtggtgtagaggtagatcccccagacggtgggcatgcggccgtcgggcttgggagcgagggcggcgacgttgcggccgcggctgtaggcctgggtgtagtggccgtactcggcgcccgcgccttcggcgaaggtccacccgaagagctcaccgtagaagcgcttgcccgcctcgacgtccggaagcgatgcgtccacccagcagggtgcgccttccgcgaatgcggccatgggcccgtttccttccgttgtgcgggggtgtgtaccctcccaaccctctcagccatgatccgcccgaaaacttgtccacagcctgttgataagactattcgggggaaatcccgtggaaccgggcgacacgcccgggccggcggccggcgcgccgcgcggcccggccgggggcgcgcgggacccgtttcccggccgaaatgcgcctgcgccgcggcccgcgaccgtcttccgcccaggccagcgaccccgtaaccccatttgcaggcggccgaatagcgcgccgatcacccctcggtaagctgacggcatgacaggacaagtacgcaccgtcgacgggcgtgtcgccggccggcgcggccaggcgacgcggcagaagctgctcgactgcctcagcgagatgctcagctcctcgccgtaccgcgacgtcaaagtgatcgacgtcgcccgcaaggccggtacctcccccgcgaccttctaccagtacttcccggacgtcgagggcgccgtcctggagatcgccgaacaaatggcgaccgagggcgcgcagttgacgtcgctcgtcgagggtcggacctgggtcggcaagtcagggtgggccgccgccgaggaactcgtcgagggcttcctggaattctggcgccgcaacgacgcgatcctgcgggtcgtcgacctcggcgcggccgagggcgacaagcgcttctacaagatccgcatgaagatcctgaactcggtcaccaactccctcacggaatcgatgaaggagctccaggccaagggcaaggtcgacaaggacatcagccccgcggcgatggccggttcactggtcgcgatgctggccgcggtcgcctcgcaccagaagggcttccagacctggggcgtcaagcaggccgagctcaagccgaacctggcactgctcgtccacctcggcatcacgggcaagaagcccacgaagtagcggcggacccccggacgccctccaggggcccgccgaccacgcccgatcgcctccgcctgcgatcagcgacgctccaggcggaacaaccggatctcgcgctcgatgcgcgcctggtacgccgcatacggcggccagaacctcagcaccgcctgccacgcctccgcgcgttcctcacccgccagcagccgggcccggacggggatgtcccggccttgccaactcacgtccgcgtccgggtgcttgagcaggttcccggtccatgccgggtgcccgggccggccgaagttggagccgatcaggatccacgtcgtcgcgccgtcctccggcatgcaggcgagcggggtcgtgcgcggctcaccggtcctggcgcccttggccgtgaggatcacgcccggcagcatctgggcactgaggatgaccttgccgcgggtcagcctgtgcacggccttgtccatggcggggatgaagtgcggtgcgatcttggcgaacagcatggtcgaggagaccttctgcatcagcttgacgccgggagccacgcgagccatcagacggccaccttctcttgtgcgggcggggacgcgggcgggggcgcagacgtggacggcgacgcgggcggcgcggaggcctcccgcgcggccggcgccggaaggggccccatggccgccgccgggtccgcgaacaggcccgcgcggttggcggcgtgcgcccggagccggtggaccgggccgaacagcagctcgtcggccgccgcccgcttgaagtagaggtgcgcgtcgtgctcccaggtgaagccgatgccgccgtgcagctggatcgcctcccccgcggtcatccgcagggcctccaggcactgcgcgagggcgaggccgccctggtccgggtcccaggccgcgtagtaggccgccgagcgggccgcctgcacctgcacgtacaggtcggcgaggcggtgcttgaccgcctggaaggagccgatcgcccggccgaactgctcgcgcccgcgtacgtactccaccgtgcgggccagcgcctgaccggccgcgccgaccgcctcggcggccagtacggcggaggcggtgcgcccggtggcggcgagcgcgccgagcacatcggccccttcgccgccgagcaactctgccgggacgtcccgcagttcgatcctggcctgcgggcgggtctcgtccaggacggcctgccgggaccgtacgagccccggcgcgtcctcccgtacgaggaacagcagcgtgcggctgcgcgcgaagccgccggtgtgggccgcgaccagcagcaggccggcgctgtgcccgtcgagcacctgggcggcctccccgtacaaccgccagccgcccccggcggcgtcggccgcgacggcccgggcctggaccccgcccgcgcggccaccaccggaccactgcccggaggcgtcctcgccggtcagcgcaagggcggtggccagcgccgggccgctgacggcgagggcggcggtcagcccgcccgtcgccagcggcgggagcagcgcggagcgctgggcggcggtaccgagggcggtgaccagcggcacgcacagcgcggcggtggccagcagcggcgagggcagcagcacccgcccggtctcctcgcaggccagcgccaggtcggcgggggcgcagccgacgccgccgtactcctcggcgacggcgatgcccggcagcccgagctgccgggagagctgctgccacagctcgcggtcgtgtccggcagcggtgcggactgcggccttgacctcgtcggggccgcagcgtttgcccaggatctcgcgcagggtacggcgtatctcgtcctgctccgcggtgacggcggcatccatcgtcgggctcctccccgtatctgacgggccgtcatgttaggcccggcggggacagaagcacagggggcggcgggggcgggttgcgcggcggggtctagcgtctgacacttcgtcagatataccgtcccctcatgcctggacccacatctggacccacatctggacccacacctggactcacgtccggacccgcaccccgcgcccgccggagggccgccgtggtcggcgtcgccctctcggactgcggacgggtcgacggccccaccccctacgccctgcacgcgcaggccgcccggggggccctggccgactccggcctcgaccgctccgtcatcgacggcttcgcctcggccggcctcggcacgctcgcaccggtcgaggtggccgagtacctgggcctgcgccccacctgggtcgactccacctcggtcggcggctcgacctgggaggtcatggccgcccacgcggcggacgcgatcgccgccgggcacgccaacgccgtgctcctggtctacggctccacggcccgcgcggacatcaaggcccggcgccgcacgtccaacctctccttcggagcgcggggaccgctgcagttcgaggtcccgtacggccacacgctgatctccaagtacgcgatggccgcccgccgccacatgcacgagtacgggacgacgctggagcagctcgcctccgtcgccgtacaggcccgggcgaacgcggccacgaacccggacgcgatgttccgcgacccgctcacggtggacgaggtcctctcctccgacatgatcgcggacccgttcacgaagctgcactgctgcatccgctcggacggcggctgcgcggtactcctggccgcggaggactacgtacccgacaccgcgaaggcccccgtctggatcctgggggcgggcacctccgtctcccacaccaccatgtcggagtgggaggacttcacggtgtccccggcggccgtctcgggccgcatcgccttcgagcgggccggcctcaccccggcggacgtggacctcgcggagatctacgacgccttcacctacatgaccctggtgaccctggaggacctcggcttctgcgcgaagggcgagggcggggcgttcgtggagaaggggcgcctgctgcgcgacggggaactccccgtcaacaccgacggcggcggcctctcagcctgccacccgggcatgcgcggcctgttcctcctggtcgaggcggtccgccagctccgcggcgaggcgggggccggccaggtcaccaaacccggcggccgcctcccggaggtggccctggcctcgggcacgggcggctggttctgctcgtcgggaacggtcctgctggggcgggggtgagcgcccccgcccgggggcggcctacttcccctcggcgagggtgtgcgccacgagcgcgttggcgtgaccgtgcccgagcccgtgctcggtcttgagccaggacacgagctccatgtgcttggtcagcggcgaggaccggatgaggtcctgccactccccgatcggacgtccgtacttcttctcgatcgaggggaaatagctggcggggcccttggccgtctcggccatgacggatctcctcagaatggcggcgtgcggtgcgtgtcgtaatgatgactcccgccgcgcgggcaactcatcggtgagacggcgtatttcttcgcggccaagaccgagcccacggaagccgggcggcagctccggcacgcgggagccagccccggacagcgcggcacccgccccggacagcgaaagccaagcgccccgaaccggcagaccgggcggcagctccggcaggcgggagccgcccgggcggtggtcagtgacgcgtatgggggtttcccgtcagtctcatcgtctctccgtgtcgggccggcccctcaagggcgctccttcgtcgcgtcgctacgcgatggcctgacggccacccttgaccgaccgacccgccccggaaatccgaagactgccgagaagcccccaaaagaacgagccgggcactcaagacagggacggggcggccagagacccccggcccggacgggggcgggcacacccgacaggcggggcccatgacagcagcctgccgggtcgggggaagcgccccacatcgctacgcgctccccatctctcagcgtctccagcccgtcgtgggccggacataggccgcccacagcctcgatccggcactcgacctgcgaccgacgaccggccggggccggacataggccgcctacgaccccggtcccgccatcgacgcgcgtccgacgaccgtccggggccgggcacaagccgcccaccccccattcgcttctcccagactgcgtccggcggccggtttggtgctgatgagagccgctgagaggggctgacggctgagagctccggtattccgtcgtggaaccgggtcagcgagaccacggcaccacaaacccatcaccaaacaagggcaattggggcaaactggcggccttctgggccgcccatgtgcgctgacctgcatccacgacgaaatagccgcagtcccacgccctttcgccccggacgacggccagacgcagtcaaagaggaccctcaacgcacctgggcgcgcgccgaccgtcggccgccgtcagcgagaagcgcgtggatggtgagcggcttatgaccggccccggacggtcgtcggtcgcaggtcgagtgccgggtcgaggtcgtgggcggcctatgtccatcccaggacggtcgtcggacgctgagacgtggggagcgcgtagcgatgtggggcgcttcccccgacgcgggcggcggctgtcatgggccccgtctcgggaatgtgcccgcccgggaccgggcagggcatctccgaccgccccgtcctgatccttgagggcccggcccgttcctttgggggcttcccggcagtctttcgtttctccggggcgggtcggtcggtcaagggtggccgtcaggccatcgcgtagcgacgcgacgacgaaggaggagcgcccttgaggggccggcccgacacggagggacgatgggactgacgggaagcccccatacgcctctctgaccaccgcccgagcggaaccgcccctccggagcccccgccccgccaaccgaccccccgccgcccggctccgcgcgcccggagcccccggcccgcccccactggcctgccgggcccgtcctgctgttccatgggccccatgagcagcagcgagatcggcgagatccacgagaccggtgagcccggcgagatcagcagtgacgtcttccacgccaccctgcattccctgcgcgtgtgggactccccgctccccgggttcgataccgcggccgcgcccggtgagcccgtggcgctgttccgggagtggttcgtacatgccgcgcgggcggggcagttggagccgcacaccatgagtctggccaccgtggacgggcaggggcggcccgacgtgcggacgctgatgctgcacgaggccgacgcgcgcggctggcacttcgcctcgcacgccaccagcgccaagggcgtgcagctggccgggcgaccggaggcggcgctcgggttctactggccctccgtgggccgccaggtccgcgtgcggggccgggtcagcgcctgcgggcccgaggagagccgggcggacctggcggtccgctcgcgcggcgcgctcgccgccgcgctcacgggccggcagagcgaggtgctcggctccgtggaggagctggcgcgggtctcggcggcggcctgggagcgggccggagccgagccggacgcgccggctccgacgtggacgcggtacgtgctggatcccgccgaggtggagttcttccagggggatgccgcgcgccggcacgtccgcctgcggtactcccgtaccgcggagggctcctgggaccgcgagctgctctggccctgaccgccgccgcccggtggaggccctcagtcgggcgccggccggaagaccgccacccacaccccgtccgccgcctcgcggaaggtgaccgccagcggcatgccgatgcgcagctccgccgcctcgcagtccaccacctcggtcatcatccgcgggccctcggcgaggtcgacgaccgccgccgtgtacgggacgcgcgtgccgaagggcgggaggtcgttgcggtggatcaccgaccacgtgtagagggtcgcccggccgccggcgctctcccaggtcacgcggtcctcgcccgcccagcagaacgggcagaactcgcgcgggtagtggtgcgcccgcccgcagtcggcgcagcgccgcagcagcagccgtcccgcggccgccgcgtcccagtaggggcgggtgaacgcgtcggcctcggggaggtcgtaccgcgccgtgccggtcacaggaagagtccgatcgccgcgtcgagggaccaggtctgccaggacatggcgaggagggcgacgagcgagatgagtgccatcatcgcgttctggccctgctcggcccagtcgtggatcatcagcacgaggtagagcaggttcagcaggaggccgccggccagtgcgaccggggtgaggaagccgagtaccaggcccagcccgagggcgagttccgcgtagacgacgatgtacgccatcgccttcggccgcggcgcgacgaccagctcgaagccgcccttgacgaaggtccagcggtgtttgccggcgacgtcggcggcccaggcgatgccggtgccgcgctcgaaccagcccttcttgtccttgtgccgccagctctccagccaccacaggccgaggcctatccggagcacggcgagccattcggccccactgagccagatggtctgcatcggcggcccccacccctctcgcgatcgacgcgcacgctctatctgacggtacgtcagttgagcggatccggcgcgatcgcgcaaggccccggccggccgcggatccacggcgccgcgggcgttccgcgcgccgtgatcgatccgcaatcgattccccgcccgaccgagacccatcaacccagcgtggcgatacgatcacacctcatgcccggagaccccacagcacccgacatgaccacccagccccgccccgtgtacgtcatcggggccggccccggcggcctcgccgcggccgccgcgctgcgcgcccgcggggtacgcgcggtcgtcgtcgagaagtccgacgcggtcggtgcctcctggcggcagcactacgaccggctgcacctgcacaccacgcgccggctctcggccctgcccggcctggccatgccgcgccgcttcgggcgctgggtctcccgcgacaacgtcgtgcgctacctggagaagtacgccgagttccacgagctggagctggtgaccggcgtcgaggtgacccggatcgagcccgcgcccgagggcgaggagggctggatcctgcacgccagcggcggccgggagctggcggccgcggccgtggtcgtcgccaccgggtacaaccacacccccgcactccccgactggccgggccgggacgcgtacgagggccggctgctgcacgcccgcgaataccgcaatccccagccgtacgcgggccaggacgtcctcgtcgtcggcgtcggcaacaccggcgccgagatagccgtcgacctcgtcgagggcggcgcggcccgggtgcggctcgcggtgcgcaccgcgccgcacatcatgcgccgtgccaccgcgggctggccggcccagcgcagcgggatcctcgcgcggcggctgcccgcgccggtcgtggaccggctggcggtgctcatcgccggggtctccgtcccggacctgtccgcctacgggcttccgcgcccggacaccggcctgtaccgcagggtcaagcaggggtcgataccggttcaggacgtcgggctggtcgacgccgtccgcggcggcaaggtggaaccggtggccgccgtcgaggccttcgacggcgccgaggtggtactcgcggacggctcgcggatcgccccggacacggtgatcgcggcgaccggctaccgccgggcgctggaggggctggtcggccacctcggggtgctcgacgagggcggcctgccccgcgcgcagggcgcccgcacccccgagcaggcccgcggcctgtacttcaccggcttctccaaccccatcagcgggatgttccgggagatggccatggacgcggagaagatcgccaaggcggtcgcccgccgtgccgccaaggggacacgatgagcaactccgacgccgccgccatcctgacgacccccgacctgggggaggcactgcgggccgtgcgcaccctgctggacatcgccgacaccgtgaactcggaggtcgacttcgaagcggtgatccggtcgccggaagtcctggcgcgcctgctcgggctgctgcccggcctcaaatggtcctcttcgcccgggggcgcgcacggttcgtcggacgccggcgacgacccggcgcggtgcctgccgatccgggtgttcgactggtgccacccgctcgatctcgccgagccgttcatcgccgcgctgggttccgatcccgcggccgtccgcttcgacctggacgcctggcccgaggtgcccgcggccgggctggaacgcgtctcgcagaagtacgcgtacctcacgctgtcggttaactcgcgcgacctgttccaggacgaactgttcggggaccacaccgtgcacgtgcacgtgaagaacgccgcctggcccgcacacaccgcccgcatccactggctggcggaacaggtgggcggcgccttcaccggccgggtggagtcggcgctgctctgagaccggcccgccggcccggaccgacccaccggccccgccggcccgccggccccaccggcccgccggtccgggtcggccgaatcgcgccctggaccggtcccggcgggatctgtcaccgttcacttcaccacaccacctccacacctttcctgcgcagccctgttcctgacggcacgtcagttaagtaatctgactgcacgtcagttatcgagttccatcgaggttcatcgagcaggagtgggcggcaacgatgcttggatctactcacggcaccctcaccaccgacttccgcgcacgtgtcgaggcctgcggggagtctcccaggaccgccgtccactcgtcggcggccccctccgccgacgacgcggccgccctggacgtcagcggacgcccgctgcacgccgacgtgcccgacctggaccggttcttccggcccgaatccgtggccgtcatcggcgcctccgacacggagggccggccgaacaccggcatcacccgccagctcatcgcctgggcggggcgcgtcggtgcccggatccaccccgtgcaccccacccgccccaccgtcttcgggctgacctgccacgcctccgtggccgacctccccgaacaggtggacctcgccgtcctcctcgtcgccgacccgctccccgtcatcgagcaactggccgagaccaaggtcaagttcgcggtcgccttcgcctccggcttcgccgagaccggcgagacgggcgccgccgcccaggagcggctcggcgccgccgtccggggctccggcctgcgcctgctgggccccaacaccaacctcaacgccttcgaggagttccgcgaggacctcgacggcccggcgatcgcgctcatcacccagtcgggccatcagggccggcccgtctacaccctccaggaactgggcatccggctctcccactgggcacccaccggcaacgaggcggacctggagacctccgacttcatctcctacttcgccgagcagcccgaggtcggggccatcgcctgctacgtggagggcctcaaggacggccggtccttcctgctcgccgccgaccgggccgcccgcaacggcgtccccgtcgtcgccgtcaaggtcggccgcaccgagaccggcgcgcgcatggccgcctcccacaccgggaagctgaccggcgccgacaccgtcgtggacgccgccatgcgccagttcggcgtcatccgcgtcgacggtctcgacgagctccaggacacggccgccctgctcgcccgggcccgcaagcccaaggccgacggggtcgtcgtctactccatctccggcggcaccggggcgcacttctccgacctggccaccgaggcgggcctgaccctgccgaccctctcgcaggccaagcaggacgagctccaccagtggatccccgggtacctgaacgtcgccaacccggtcgacaacggcggccacccggtcggcgactggcgcggccggaagatcatcgacgcgatcctcgccgacccgtccgtaggcgtcctgatctgcccgatcaccggccccttcccgcccatgagcgacaggctcgcgcaggacctggtggacgccgccgagcagagcgacaagctggtctgcgtgatctggggctcccccgtcggcaccgaggacgcctaccgcaccaccctcctcggctcctcccgcgtggccaccttccgtaccttcggcaactgcatcaccgccgtacgcgcctacctcggccaccaccgcttcacctccggctaccgctccccgttcgaggacgcaccgcgcacgccgtcgccctcgtaccgcaaggcgcaagccctcatgcggccgtcgcagcagctcagcgagcacgcggcgaagcagctcctgcgcgcctacgggatacgggtcccccgcgagcagctggtgaccagcgcggcggcggcggtccgcgcggccgggctggtcggctacccggtcgtgatgaaggcctcgggcccgcagctgggccacaagaccgagctcggcctcgtgaagatcggcctgacctcggcgagccagatccgagacgcgtaccgggagctgaccgacatcgcgcgctacgagaacgtgccgctcgacgggatcctggtctgccagatggtggagcggggcgtggagatggtcgtcggcgtgacccaggacgacctcttcggccccaccgtgaccgtcggcctcggcggggtcctggtggaggtcctgcacgacgcggcggtccgcgtgccgccgttcggcgaggaccaggcgcgggcgatgctgcgggagctgcgcgggcacgcactgctggagggcgtacggggggcgcccccggccgatgtggacgccctggtggaggtcgtcctgcgcatccagcggatggccctcgaactcggcgacgagctgtccgagctggacatcaaccccctgatggtcctcccccgcggccagggtgcggtggccctggacgccctggccatctgccgctgacgccgcgccggcccggcggccccggccacgtccgtccacccacgaaggggagttcacccatgaccgccgaccccgaggacgaagtcctccaccgcacggagaacaacgtctcctggatcaccctcaaccgccccgaggcgatgaacgccgtcacctgggaccagcgcgaacgcgtcatcgcgctgctcgccgaggcgtccgccgacccggcggtccgcgcggtcgtcgtcaccgccaccggcaagggcttctgcgcgggcgccgacctgcgcggcagccccggcgtccccggcagccccggcggcgagcgcgtcgccggggacgtcgcccgcatgatccggctcggtgcgcagcgcctgatcaccgccgtgctcgactgcgagaagcccgtactcgccgccgtcaacggcacggccgccggtatcggcgcgcacctcgccctcgcctgcgacctcgtgatcgccgccgaaccggcccgcttcatcgaggtgttcgtccgccgcggcctggtccccgacggcgggggcgcgtatctgctgccccggctcgtcggcccgcagaaggccaaggagctgatgttcttcggggacgccgtcccggccgccgaggcgcagcgcctgggcctggtcaaccgggtggtcgcggccgaggagctggaggcgacggcccgtgcgtgggccgagcggctcgcgcaggggcccacccgggccctggccatgaccaagcagctggtcaacgcctccctggacggtgaccgggcggcctcgctggccgccgaggccaccgcgcaggagatcaacatgggtacggcggacgcgaacgagggcgtggcgagcttcgtggagcgccgcacgcccaagtacctcggccgctgaccgtccgctacatccgcgggtcgggcttgagcagcgcgaacaccgctccggccgggtcggccagccaggcgatccggccgacctcgggcaggtcggtggccggcatgaccacggagccgccgttcgacttggccgcggtgacggtcgcgtcgacgtccgccgccatgaagtagggcacccagcgcgcccgctcgccctccccctcgcccatgaagggggcggccccgccgaaggaggcgtcctgctggtccccttcggcggtgctcagcacccggtacatcattccgggcgcgggcatctcggcgctgcgccagccgaacagccccgagtagaaggcgatgtcggcgacggggtccgcgacgtggagttcggtccacaccagcgcgttgtcggcggaggtcagctggagtccgccggtcttcccgggctgccagcaggcgaactcggcgccctgcgggtccgtgtactgggccagccagccctcgcccatgacgtccatgggctccatccggaccgtgccgccgccctcgcgcacggccgcggtggtcgcctggatgtcggggctcatgaagtgctgcatccaggcggacgtggccccctcgtcggtgagcggcccgagcgcggcgacggtcttgccgtccacctggaagaacccgtacccacccgcctcgggcccggcggagacgaactcccagcccaggacggcgtcgtagaacgcggcggccaccccggtgtccgggctaccgaggtcgagccagttgggtgatccggtggtgaagtcggtgccgagcatgggggtcctcccggggtacggcggcggtacgaggtcgctgccacgatgccgagcctccccccgcacccgggcgtacggacccccgggggcggggggtttcacccgtgcgggtgtacgggccgcccggcgcggccgccgcgggtgcgccgtccgcgggcgccgtttcagctcgggacccgctccagtgccggcaggaactggtcgtagaagtccgccttgagccgcagcgagcgccgctccgcgtccttgaagcagtcgaccgtcccgtcgtcgtcgccgagcagctccctcagccgggtgcccagccggtcggagtggctggtggccagcaggttcacggtctccagcgagtgcttcttggcgtcgtgccagtggtgcgggtagtagaagcgcgagcggttctcgccgtcgtgcaccagcaggggctccatccgctcccacagccgcccgtactcgacggaaaccaggatctcgccccagaagcgcaggaccgtcagaagcacgaggtcggcgcggtcgtggtcgcccgcgtcggcgatgagagcgaaggtgtcctcgatggcccgcctggtcgccgccgtgggccgcgaacggacgagggcagtgcgggagatcccgagctggagcatgtcgtccgtcatgtcctcgcggtgcgacttcgtgttcccgcgggcgtccgggtactcctcgcgcaggatcttccgggcggtcctcagccccacctcgtcctgcaggaggtcgatcgccaggtcgtaggccggggtgaaggcgagcgacaggaaacgccgctggagcaggatctcggcgaactcctccgccgggagccgcgtgatgttcgcgagcaccggatgctgcctgtaccgctcgatcaggtcgtcctcgaacctgtccagttcccacacggtcctactcctcactcccggatcactgactgatgtcgatcgatctcgccggatcgcgcagatccacttcgtgaccgatgtcccacagggtgtccagctccttctggacctgccggcccatcacggagtcgcacccgtctatctcgatctgcgtggactcgatggcgagctgcccgtgcaggaaggagctgaccagatagtgctcgtcggccttgtacacggcgatcgacggcagggagttgtacacccgcaccttgagcttgccctgcagttcccgcggaagacggccgtggagcctgtggaggatgtcgaggctggcgtccaccgacaccgagctgctcgtgttgcgcagcgcctggtcgcgcaggtccaccacggcggatttcgggtgcaccagcaggatgcgcacctcgacctcccgttcggtgacggccttctccagctccgtctcgaggccgtcgaggttgggtatccaggtctgcagcacggccacctcgcgccgggcaccgcccacgagccgcttgaactccgcggtggggaattccgggtggaccctcgtcacaccgaggtagtgctggcggcggagctcgccggtgaggccgtcgagcgtgaggccggagatctgggtgctgatgctgtcgagcaccttcaggcggtcgaactccatcagcaggaagagcgtgacggtgctcaggatgagcagcgtgatcttcgggagcgtgcccccgggggccatcctgtcgagccagccgaggacgtcggcgagcaggaccccgatgcccgccgtagccatcgcacccagtgagatccgctcggcccggtagcgaaaaccgttgcccatgaccaccccagcccccgacgtccctgtcgttggccatgaccatacacacggggtaccgcggtccgactggcgcctcatgtcaccttgctcacaaggtagttcaggacagtggccggatcacagagggtcgcctgcgcccggcgcgaaggtccgaggtcagcgcgatccgccgacatgccgcatgccggccccttcctatctgacggctcgtcagtttcaatcgtgggtgtgatgggacatgcagggatggcggccaccgtcgtccgatacctcaggacagtcggctcccccacctccgcctcggcgcagcgggagaccgagcccgtcgacgcgctgccgcgtcccgacctgcgggccgtcggcgcggacgagcgcgcgccggtgtcccccaccgagttcagggccgtgctggggaacttcgccagcggggtcaccgtcatcaccgcgccgcccggcgaggacgaggacggcccggccggcttcgcctgccagtccttcgcctcgctctccctcgacccgcccctggtcaccttcatggtggcccgtacgtcgaccacgtggccgcggatcgcccgcgccggggtgttctgcgtcaacatcctcggggccgaacagggtgagctgtgccggtccttcgccgtcagcggcgcggacaagttcgccggtgtgacccacaccccggcccccgtcacgggatcgccgcagctcgacgccgtgcccgcctggatcgactgccggatccaggccgtccacaccggcggggaccatctcatcgtcgtgggccgggtggtggccatgggcgccgcaggcgagggcgaaccgctcctcttccacaagggccgcttcggccgcctcgccgactgaccatggagtgaccgccgactgccctccggccgcccgccggacacccgtggaccggtcccgctcacgccgttcggtgcctggtgtcggatccgctgcgtaagctccccacggggggcggggcactcaggcgttccatccccttcggaattcttcgaatacgcggggatttgacttgatactgaacctgatgcgccgcacgcgcggcgccgtcgccgtcgcggtcgccaccgggacccttctggtggtcgcttcgccgacctcctcggcggccccggtcgccgcgcctcccgtcacggccgccggcgcgatcctgatcgacgccaccagcggggccacgctcaccagcaaggacgccgacacccagcggcagatggcgagcacgaccaagatcatgaccgctcaggtcgtgatgcgtacgcccgacctgaactacgaccagaaggtcaccatcaagcaggagtacgcggactacgtcgtccgcgagggcgccagctcggcccacctgaaggtggggtccaccccgacggtccgccagctgctgtacgggctgatgctcccgtcgggctgcgacgccgcctacgccctcgccgacaccttcggcaagggcgcgaccacccaggcccgcaccgcggacttcatcgcgcagatgaacgccaaggcgaaggcactgggcatgaccaagaccgtctacgactccttcgacggcatctcgccgaccggcaacaacctcaccaccgcgcgcgacatggcgaagctcaccaagtacgcgatgtcgggcgtcgccttcccgaagatcgtggcggcgacgacctacagcacgggcggcacctcgaccgacgccacctggggcaacagcaacctgctgatccgcgagcgtcccaccggctacgcctacccgggtgcgaccggcgtcaagaccggcaccggcaccgccgccggcaagtgcctcgtcttctccgcgacccgtaacggcaagaccgtcatcggcgtgctgctgaacgacgaggagcgctacgtggactccatggcgctgatggactgggcgctcggttcgagcaccggctccggggcggcactgcagcgcggcaacaccgacccgatcccggacgtcctcgactgacggtgacacggttcacggctcctccgccggcgggtgcgatcccgccggcggaggagccgaggcgtttgcgggcaccggcaggagggcgtcagaaggtgagcacgccgcgcgccacccgcccgtggtgggcgtcgtccacggccttcgcgaagtcctcgaccgggtagacctccgtcaccagctcgtccagcagcagcctgccctgccggtagagctcggcgtacagcgcgatgtcacgctgcgggcgcgaggacccgtaccggcagcccatgatcgtcttgtccaggtacatggacgacacgaggaacgacgcctcctcccggaagccgggcacgccgagcaggatcgcctgcccgtgccggtcgaggaggtcgatcgcctggcggatcagcttgacgttgcccacgcactcgaaggcgtggtcggcgccggtcggcaggatctcgcggaccgcctccgacgagtcggccacggcggaggcgtcgatgaagtgcgtggcgccgaactgccgggccaccgcctccttcgccgggttcgcgtccaccgccacgatcgtcgtggcacccgcgatccgggccccctgcagcacgttcagcccgatgccgccggtgccgatgacgaccacgctctcgccccggtccacgcgcgcccggttcagtaccgcccccacgcccgtgaggaccccgcagccgatgagcgccgccgaggtcagcggaatgtcggccgggatcttcaccgcctgcacggccctgacgatcgtccgctccgcgaaggcggagttggaggcgaactggaacagcggctgcccgccccgcgagaacggccggcccggcatcccgatcgccttgcggcacatcgtcggccggccccggtcgcagtccgcgcacgccccgcagttggcgagggtggacagagccacgtggtcgcccggctccacgtgcgtgacgcccgcccccaccgcctccacgatgcccgcgccctcgtgcccgagcaccaccggcggcgggaaggggatcgtcccgtcgatcaccgacaggtcgctgtgacacagcccggccgccccgatcgcgaccagcacctcccccggccccgggtcccggatctccaggtcgtcgaccacctgggcctgcttgccgtcgaacacgacgcctctcacctgggctccttaggcaggccgagcacacgctcggcgatgatgttccgctggatctcgtccgagccgccgtagatggtgtcggcgcgggtgaacaggaacaggcgctgctcctcgtcgagtccgagttcgtacgggagcccgggcgcccagcccgccggcccggcggaagccgccgcgccgcggacctccaccgccagctcccccagccgccggtgccagccgccccacagcagcttggccacgctgggcgcgcccgcgtccccctcggctcccagggtgcgcagcgcgttccaccgcatggtgcgcagctgcgcccactgccggaccagccgctcccgcaggacggcgtccccggctccggcggcggcccgtgccgcgtacgacgccagtacgcgctccagttccgccgcgaacccgatctgctgcaccagggtcgagacgccccgctccagggcgagcaggcccatggccacggtccagccgtcgccctcggcgccgacgacctccgccgcgaccgccccgtcgaagaacacctcgttgaactcgctcgtgcccgacatctgccggatgggccggacctcgacgcggccgggctggtccatgcgtacgagcaggaacgacagcccccggtggcggcgcgagccgggctcggtgcgggccaggacgaagcaccagtcggcgtcctgggcgagcgaggtccagatcttctggccggtgacccggtacagcccgtcggccgcgtcccgtaccgcggccgtacggatccccgcgaggtcggacccggcgcccggctcgctgtagccctggcaccacagctcctccccccgcgcgatgccgggcaggaaccggtcccgctgctcgggcgacccgtacgcgatgagggtcggggcgaggaggttctcgccgatgtggccgacccggccgggcgcgcgcagggccgcgtactcctccgcccacaccacctgcccggtcagcgacagccgccggttgccccacccgtcggcctcccagccctgcccgatccagccgccccggccgagctcgcgctcccacgcccgccggatcccggtcccctcgtgctcgctgcccgggccgccgaggccgacggcctgcgcgtacgggcccacgaggtgctccgccagccacgcccgggcgcgccgccgcagctcctcgtcctcggccccgaaactgaagtccacgccgcgcccctacgcgttggggcggtccttggcggccgccgccttcgccatcgcctccagttgcgcgagcatcggcatcgggtcggtgccgaccgtgccgggcaggaagtcggcgatcttctccggcgtccaggagccctcggcgtatccggcgcgcagctcgcgcggctgcgcccagacggcgatcttcgggccggcgatcgtgtagacctgcccggtgatgtcctcggcccgggcccggtcgctgagcaggtaggtgaccagcgccgccacgtcctcgggctcgccgatctccttgagctccatggggacgttcgcggacatgcgggtgcgggcgacgggtgcgacggcgttggccgtgaccccgtacttggccaggcccagtgcggcggagcggacgagggagatgatcccgcccttggcagcgctgtagttggcctgggcgacggagccctggtggttgccgctggtgaagccgatcagggtgcccgtgccctgccggcgcatgacggcggaggcggcgcggaagacggtgaaggttcccttgaggtgggtggcgacgaccgggtcccactcctcctcggacatgttgaacagcatccgttcgcgcaggatgccggccacgcagacgactccgtcgatgcgtccgtaccgtgcgagcgcggtgtcgacgaggcgctggccgcccgccatggtggagatgtcgtcggcgacggcgacggcctccccgccgagggcggtgatctccttcaccacggcttcggcgatctcgctggtgggctccgcgccctcgatcccgaccccgtagtcgttgacgacgaccttggcgccctcggcggccgcggcgagtgccacggcccgtccgatgccccggccggcgccggtgacggccacgaccttgcctgccaagaagttccccacgtccggccccttcccgcgatttctgacggaccgttagattctatgggtagtcagatacacctgcacaagccctcgttgacgtcgtaaccaccgcatccacgcaaggagctgtcgacgcccatgaccctgcccgccgagttccacgacatcgccaagcgcgtcaacaactggggacgctggggagccgacgacgagatcggcaccctgaacctgatcaccgacgaggtggtccggggcgccgcggccgagatccgcaccggccgccggatcccgctcgccctgccgctcaaggaggacggggtccaggtcggcatgatccccggccggatcaacccgctgcacacgatggtgcagatcaaccaggagctcttcggccccggaacggtggcgtgcagcgacgacgccgtgagcatgggcctccaggcgggcacccactgggacgccctcacccacgtctcgcactcggggaagatctacaacggccgcccggccggcaccatcacggcacacggccgcgccgagttcagcggcatagacaaggccggacacatcgtctcgcgcggcgtgctcctcgacgtcgcgcgcaccaaggggctggaccggctgccgggggaccacgcggtgacccccggggacctgacggaggccgaggagttcggcggggtcaccgtccgccccggtgacatcgtcctggtccgcaccggccagatccaggtctacctggcgggcgacaagcacggctacgggttcccctcgcccggactgtccgtccgcacccccgagtggttccacgcgcgggacgtggcggccgtcgcgaacgacaccctgaccttcgagatcttcccgccggaggtcgagaacctgtggctgccggtccacgccctccacctggtcgagatgggcatgcaccagggccagaactggaacctcgaaaagttgtccacagcctgtgcagaagaaaaccggtacgccttcctcctctccgcgatgccggaacccttcgtcggcggcaccggcacccccgtggccccggtggccgtcctctgagcccggcgggcaggcggcgccggaccggacggccccggccacccgcgagccgtgggcggtggaaccatgaggtgtacatgccgcgtcaccgtacgcgcgtcacgccccgtccccaccaccttccccgcaggagaagctcgcatggccaacccgtaccaggtaacgccgccgcccgcccccaggcgccgctcgggcggcaacgtcgtcgccgtcatcgtcctcgccgtggtcatcatcggcggctacttcatcatgcagtccctccgcaaggacgacggcaagccgacggcgtccccctccgcctccccctccaccaagcccaccgccaaggaccccggatcccccgagtcctcctccgacacctccagttcgtggaaggtcggcgactgcggcggccccgacccgtccaaggcaccggacggatacaagcgggcgggctgctccgactccggggccaccttcaaggccatcgacatcaaggaggccagcatcctcccgaacgcggtccagtgcccgcccggcacggacctgatgatcgacgtgagcatctcctacggcggcaaggggagcggcatccccaccaacaccgtctgcggccgcaacctctcgggcgaccaccccggtgacgccggcgccggcggcggccagctggtgaagggtgactgcgtgacctcccaggccaaggaggtcgcctgcggcggttcgggcgcccagaaggtgctcggcctcgtcaagacgaagtccgagtgcccctccggcaccaccgacccgatcgagctgaccatcgcgatcggccgcccgtacgacgtgatctgcaccgacggctgagcggcccctgcggcggcggcaccgctccaccgccaccgccgcaggccgcgcccgcgcccggcccggtcacagggagggcggccggcccgaaaattccgtgctccggcgccggcgaaggcgcagactcgccctatgacggacatgcgggcgttccgggatgcggtcaccggctgggcgggcggcggacccggcggggccgcacgcgaactggccgtccgcctcaacgtacggacggcggtgctcctggaagggcccagcgatcacgcggccgtcgaggcactggccgcacggcgcggccgcgacctcgccgccgagggagtgtgcgtcgtaccgatgggcggggcgatgagcgtggcccgctacgccgcactcctcgggccgcccggcctgggcctgcgcctgacgggactgtgcgacgagcgcgagcagcccttctacgaccgcggcctggaccgggcgcgggcgccgcgccggggcttcttcgtgtgcgtggcggacctggaggaggagctcatccgcgccctcggcccggcggcggtcgaggagatcttcggggccgagggcgacctccgcgcctggcagaccttcctgcgccagcccgcgcagcacggccggccccggcagcagcaggtgcggcgcttcctcggcacgcagaagggccgcaagatccgctacggccgcctgctcgtcgaggccctggaccccgaccggacaccggccccgctcgacgatctcctggcgtgcctgtgaccggcgccggccgacggccggaccaggcaggttctgcgggtggcggcggcgcgcatgcacgccccgagcgcggcacgagcggccgccaccccacgacccgcactcgtcaaggcctgtccttggcgtcccctcgcgtcgaatcgctccacaccagggtgatcaagatgtgacgaaccgtcaacacctcgttagaggtacacgcgcggttcccgaggcggggtatgacattccgacgggccgtccgaggagcatgcggaggcgcagtccgaggtggatttctccgcgcggtcgatctcgcaccagatctgcttgcccgcgccctcgcgctgccagccccagcggtccgccaacccgtcgaccagttcgagcccgcgcccgcccgtgtcctccccgcacgcctgccggcggctcggcgcccggtcgctcgcgtcggccacctcgacccgcacccccggccccccgaacagcatccgcagcacggccggacagcccgtgtgcacgaccgcgttcgtgaccagttcggagatcagcaggatcagcgtctcggcgagcggttcgtcgtcccctatgcccgaccccgccagccgggaacgcgcccaccggcgggcccggccgacctcggcgggatccgcaccgacctccagctgaacctgaagcacctgcaccgctcacaccatccgaaccggcggacacttcgcctcgcgacaggacgggatcaccgactgtgacccccttccgtagcagcatggttgacatacagtcaccacaacaagcgcttcgggcatattcccccgcgaaggagtgggcgtggtgcatactgtgcgacgctcgcgccgctcaaccgctcgcattcgtgggagcgtaccggagcaggcccccgcttccgggccgcaatgggttgggtgaaggacacaaaccgatatcaactctctgtaatcggacatgcgtcccgcgccgtccttcccgtgcctccacatcaccgtgagcgacgtccgccgaccgggaacctacccggccgagcccagcagctcctgcgccagcagctcctccgcctcccccgccgtccgccactgctcggaccgcacccaggcccgcttcaggtgcaggtgcacgtcggcctcccaggtgaaacccatcccgccgtgcacctgcaggcagtcccgggcgttgcccaccgccgccccgtccgcgaggagcttggccgcggccacctcgcccgggtcctgcgtcaccgccgccgcgtagaccgccgtacgggccacctccgcccgcaccagcatccccgcgcacagatgcttgaccgcctggaacgccccgatcggctgcccgaactgctcgcgctcgcccgcgtaccgcaccgccagctccaccgtccgcaacgcgctcccgagctgcagcgccgccgtcagcagcgcgcccgcctcgcggaacgcggaacagtcgccgacgctgcggccgttgccgtcgccgccgccgccgtacgaggccacccggtgcagtggggtcagcgggtccaccgagcgcaccggctcgcccgccggcaccgcggacgcccccagcaccgcgtccgcctccccgaggtgggccaccagccgcccgcccaggtcgaaggcgctcaccaccgccgttcccgccgccgcccccgggaccaccccggcagccaggtgcgtggccaccagcggcccgggcaccagcgcccgcccggcctcctcgaagaccaggaccgcctccggcagccccaggccgacaccgccctcggattcgggcaggcgcagcgcgaagaagcccgccgcccccagctcccgccacagcccccggtccacggcggtgcccgtgtccagggaggcgcgcagcgcctcgcggccgtaccggcccgccaggaggtcccgtacgcccgcccgcaggtccttctggtcctcggtcggctggaagtccatgccctcaccggcccttcgggaggccgaggatccgctcggcgacgatgttccgctggatctgcgaggtgcccgccgcgatcgtgtacgagagggaggagagccggtccagggtccactcctcctccagggacagggactgggccccgaggacctccgccgccgtgtcgtacagctcctggcgggcgtgcgagtaggcgagcttgaagacggaaccgccgatgccggggaccccgcccgccgaccgcccggcctcgctcacgttccactgggtgagccgccacagcgctccgaactccccgtacagccgccccagcctgcgccgcaggaccgggtcgtcccagcggccgttggccttcgcggtccgggccagttcccccagggtccggcggcaggcgacgacctcgccgacgaaggcggtgccccgctcgaaggacagcgtgaccatggtgacccgccagccgtcgttctccgcgccgacccggtcggccaccgggacccggacgtcgtcgaggaacatctccgcgaactccgtcgacccggcgagcgtgcgcagcggccgtacggtgactcccggcgcgtccatcggcatggccagccaggtgatcccgcggtgcttgggggcgtcggggtccgtgcgtacgagcagctcgcaccagtcggctacctccgcgtgcgaggtccagatcttggacccgctgatcacgtagtcgtcgccgtcccgcacggcccgcgtccgcagggaggccaggtcggagcccgcgtccggctcgctgaacccctggcaccacacctcgtcgccgcgcagcacgggcggcagccagcgcgcccgctgcgcggccgtgccctcggcggcgatcgtcgggccggcgtgcagcagcccgacgaagttcgcgccgacgtagggggccccggcgcgctcggtctcctccaggaagatcaggtgctgggtcggggtggccccccggccgcccgcgtcgaccggccagtgcaggcccgcgtacccggcctcgtacagcctgcgctgccagccgaggtcgtacgcgcgccggcccggccagtcgtccggggacggccgggcgggcagctcggggagcaccttggcgagccacgcgcgcagccgggcccggaagtcctgctcctcctcggtgtaggtcaggtccatcagcggctcgtgcggtcccggtcgaaggacaggtcgagcatgcggatggcgttgccgcgcatcagcttgtagaccgtctcgtcgtcgagccccttcacgtggtcgagggcgacctccttggtgtgcgggaaggtcgagtccacgtgcgggtagtcggtctcgaaggtggcgttgtcgcggccgacgacgtcgagggaggcgatcccgtgcttgtcgcggaagaagcagcagaacatctgccggtagtagtaggtggacggcggctcggggatcaggtcgcggaccccgccccaggcccggtgctcctcccagacgtcgtcggcgcgctccagggcgtaggggatccagcccatctggccctcgctgtaggcgagcttgagcgtggggaacttgacgagcaccccgctgaagaggaagtccatcatcgaggccatcgcgttgttgaagctgagcgaggcctggacggcggggggcgcgtcgggggaggcggcgggcatctgggagctggacccgatgtgcatgttgatcaccgtgccggtctcctggcagacggcgaagaaggggtcccagtagccggagtggatggagggcaggccgaggtaggtgggaatctcggagaaggtcaccgccttcaccccgcgggccgcgttgcgccggatctcggcgacggcgaggtcgatgtcccagagcgggatgatgcacagcggaatcagccggccgccgctgtccccgcaccactcctcgaccatccagtcgttgtaggcgcgcacgcaggcgagggcgacctccttgtcatgggcctcggcgaacgtctggccgcagaagcgcgggaacgtcgggaagcacagcgacgcctcgacatggttcaggtccatgtcgagcaggcgcgccttggggtcccagcagccgcggcgcatctcctcgcgggtgatgccctccagggtcatgtcgtcgcggtcgaagccgacggcggcgatgttgcgcttgtacgggaacttcaggtcctcgtagatccaccagtcggtcggcggtccgtcggggtccatggtgatgacgtacttgccgccggtgtaggcgagttcgccgatgccggcggtgagcgccttgggcccgcggtcgcggtacttcgcgggcagccagacatcgaacaggtgcgcgggctcgatcacgtggtcgtcgacgctgatgatccgaggcagttccatggtctccccaattcaccgatctgatggatcgtcagaaacaagctagccccgccacccctggaccgacaagcgtcggcgccctacgctctgcgcttgatctgactatccgtcagctcaaggttcggccacgagctcggccaaggggaggtctgggatgacggacaccgcgaccgcgacagaactgagccggtcccgcaccctgtgggaactcatctcccgccgggccgcactgaccccggacaccaccgccctgatcgaggcggccgaccaccccgcccacgaccgccggctcaccttcggcgaactgcacgaccgcgccgaacgcgtcgccgccggcctgcacgacacgggcgtacgccccggcaccgtcgtcgcctggcagctccccacccgcatcgagaccgtgctgctctccgccgccctcgcccgcatcggcgccgtccagacccccgtcatccccttctaccgggaccgcgaggtcggcttcgccctccgcgagtccaaggccgagtacttcgccgtccccggaacctggcgcggcttcgaccacaccgccatggcctcccgcctcggcgcgcgcggcgtcctggaggcctacgacaccctccccgagggcgacccggccaccctccccgcgccacccgcctccggcaccgacgtccgctggatctactggacctccggcaccacctccgaccccaagggcgtcctgcacaccgaccgctccctgatcgcgggcggctcctgcctcgcccacgccctgcgcctgcgcccctccgacgtcggctccatggccttcccgtacgcgcacataggcggccccgactacctggtgatgctgctcctgtacggcttccccgccgtcctcttcgagaagttcgcgatgccggacgcgctggacgggtaccgccgccacggggtcaccgtggccggcggatcgacggccttctactccatgttcctgaccgagcagcgcaaggccccggacatcccgctgatccccaccctgcgcctcctggcgggcggcggcgcccccaaacccccggagatctaccacgcggtcgtacgggaactgcgctgccagctgacccacggctacggcatgaccgaggtcccgatgatcaccatgggcgccccggacgacacccccgagaacctcgccgccaccgagggccgccccccggcgggcatgtccatccgcatcaccaccccggacggcaccgaactgcccccggacacggacggcgaggtccgcctccggggcgaggccgtctgccagggctacctgaacggcgacgagcggaccgaggccttcgaccgcgacggctacctggtcacgggcgacctcggccacctcacggaggacggctacctggtcctcaccggccgcagcaaggacgtcatcatccgcaagggcgagaacatctcggcgaaggagatcgaggacctcctccaccagctccccggcgtcacggacgtcgcggtcatcggcctcccggacgcgacccgcggcgaacgcgtctgcgcggtcgtggaacaacccccgtcggccgcccccctgaccctcccccagctgaccgcctacctccgcacccaaggcctggccacccacaaactcccggaacaactggaactcctggaggccctcccccgcaacgacgccctgcgcaaggtcctgaagtacaaactgcgcgagcgatacgcgtaggggggacgggggtggcggggggggatggggagacgggggacccacctttccaggcgcgggacggctgcgggaggagcggaatccacgggagcggtggtcagtgacgtgcttgggggtttcccgtcagtctcatcgtctctccgcggcgggccggtccctcaagggcgctcctccttcgtcgtcgcgtcgctacgcgatggccttcggccacccttgaccgaccgacccgccccggaaatccgaagactgccgagaagcccccaaaagaacgagccgggcactcaaggatcagagcggggcggccagagaccccctgcccggacgggagtggggcacgcccgacaggcggggcccatccagacccggacccggatcgggggaggcgcgtccaatcgctacgcgctcctgacgtctcagcgtccgacgaccgtcctgggctggacataggccgcccatggccgcgatccggcgctcgacctgcgtccgacggccggcctgggctggacataggccgcccacggcctcggttcggcgctcgacctgcgtccgacgaccggccgggggccgggcaagacggcccaccacccgtcggcgcgcgtccgacggccggcgggggcggcggagagggactggcggctcattcctcggctattgcgtcgtgaacaagggtcatcgcagcaccgggctcacgagctggggtgtaaataggggcaataagacccaaacggctggcctttgagacgcacacgtgggctgacccggatgcacgacggaatagccgcagtccggcgtccgtccgtcgacatcgagccacccgccggatgcacggcgaatgtgatcgtttgacgcgggccaaatgagttgaactcttctcgtcagccgggaggatgggagcgctcggcgaggacgcgagcagattccgggcggttggaggaagcatggccaaggaattccaggtgacgtacgactgcgcggatccgggagcgcaggcggtgttctgggcgcaggcgctgggttaccaggtccagcccccgcccgaggggttccccgactggccggccgcactcaccgcttggggcgtaccgcccgagcagcacaacagccggtccgccatcacggatccggacggaaaggggccgaggatcttcttccagcaggtcccggagggaaagaccggcaagaaccgcctgcatctggacgtgcgctccgcccccggcctcaagggggacgagcggatggccgtgctggaggaggagtgcacccggctggaaggcctgggcgcgaagcggctgtaccgcttggacggcaatgccatggatcaggggatcatcgtcatggccgaccctgaggggaacgagttctgcctggactgacgggcggatcagccacggacggccgccggtcgcggtccgcgagaagcgcgtagcgatccggggcggcctatgtccggcccacgacgggctggagacgctgagacgtcgggagcgcgtagcgattggacgcgcctcccccgacccggcaggccgctgccatgggccccgtctgtcgggtgtccccgcccccgaccgggccgggcatctctggccgccccgtcccttggagcctggaccggctcgttcttttgggggcttctcggcagtcttcggatttccgtggcgggtcggtcggtcaagggtggccgcaaggccatcgcgaagcgacgcgacgaaggagcgcccttgagggaccggcccgacacggagagacgatgagactgacgggaaacccccaagcacatcgctgaccaccgcccgagcagctcccgccctccggagccaccgccccaccacccgaccccgcccgcagcggcctagctcctacagcctgctcagtgaggccgccgcgaacaggacatcgcggatcgcctcgcggtcaccgtgctggcccaccgccgcctcctccggggagatgtgcccggcggccagctggcagaactcgatgccgtccagggcgatctccgcgaccgtccgttccggcgacggtttcgctcccggcgagtccagcgcgatgtcccagcctccgccgcccgctccctcgatctccaggtgcagggtccgcccgggcgcgcccgccgcgaccaggccccgcgccggggcggccagacccgcgcgcctgcgctgcgccagcgcgctcggcaggagccgcgccgccaggtcgatcatcccgtgcaggtgcggcccggacggcggctcgtacgggtagtccaccgcctccgcgatgtcccacgcgtgcacccagcactcgaaggcccgttccaggaaggcgtctccgagcggcagcgcgaagcccccgtagtccaccgccagctcggcgactccccggcccgcgaaggagaccgtacgcaccagcgtgtggccctgttcccgccacgggtcgcggacctgccgggtgaccgggtacggcgacgcaccccagaggtgctcggtccgcagggtcggaccgcccttcggcgcgtccggacccagcgggtcgtcgagccccagcgccgaggcgatcagcccgtccaccgacagcagatggccgatcacccccgccaccgtggtccgctgcgaccggcgccgttcctcctcgaaccacttgagccgcaccggggtgtgccattccgagtccccgaagtcctgcagcagcgcgtcgagccgcgcggtctcggtgtcgtagcgcagaatacgagcgcaagatcgccgcccgattcgccaccttcgaccaggacgggtccggctatatcgaccgggaggacttcagcgcggccgctaaggccgtcctggccgaattcggtaccaccgcccggtcggacaagggccaggccgtcttcgcgggcgccgaggccttctggcagggaatggccggcatcgcggacgtcgacggggaccagcgggtgtcccgcgaggagttcatcaccggggccgcgaagcggctgcgcgacaacccggagcggttcgcggagatcgcgcggccgttcctgcgggccgtgatcgcggtggcggacgaggacggcggcggcgcgacgccaccgaacgcggcccgggtgctgcgtgtcctgggcaccgccccggagctggccaccgaggtggcggcggccctggacgcggaccgcgacggccgtatctcggaggacgagatcctggcggccttcgcgggctactgcggggtggaagcccccgacgcgtaacgcctgcggcgcgcccggccgtacatccggctgcgccgacacgatccagccccgtcggcgtgcgaggcgcgggggtccgggggcagcgcccccggcagcccggcccgcacgggccgaccgcgcctcacacgccggcggggccgtacttcgctacgcgaacaccaccgtgcgggcgccgttcaggagcacgcggtgctcgctgtgccacttcaccgcgcgcgcgagcgcctggcactccacgtcccgcccgatcgccaccagctggtccggcgtcacctcgtggccgacccgctcgacctcctgctcgatgatcggtccctcgtcgaggttcgccgtcacgtagtgcgcggtcgcgccgatcagcttcacgcctcgcgcgtgcgcctggtggtacggcttcgcgcccttgaagctcggcaggaacgagtggtggatgttgatgatccgcccgctcagttccgtgcacagcttgtccgacagcacctgcatgtagcgcgccaggaccaccaggtcgacgttctcggcgcgcaccagctccagcagccgctcctccgcctccgccttcgtgtccttcgtgaccggaatgtgcacgaacgggatgtcgtaggagccgaccagttcggcgaagtcggtgtggttggagaccacggccgcgatctccaccggcagggcgccgatccgcgtacggaacagcaggtcgttcaggcagtgcccgaacttggacaccatgaggatgatccgcatgcgctcctcggagcggtggatctgccagtccatcttgaacgagtcgccgatcgcggcgaagctggcgcgcagcttgtcgaccgtcaccgggggctcggcctcgaagtgcacccgcatgaagaagagcccggtctcccggtctccgaactgctggctgtccacgatgttgcatccggtcatgaagaggtaactcgacacggcatgcacgatgccctgcttgtcggggcaggacatggtcaggacgtactgcggctggggctggtgctgggccggggcctcggtgtgcgggtcgctcatgaccgcacagcctttcacaccgcgcgggtgaggatcttcagcgcatcgagcgatgtcggtcgcacgtcggggtcgtccccgtcggcttccgccagccgtacgtgcgcctcgcgcgcggcacgtaccgcctcgggccacgcgtggtgctccaggtaggcggagacgggggcgtcgggcccgacctggtggaggatgcggagcacccgcagcacggcgaggtcgacgacggccgcctcctgcgagtcgcggaagatcgtgccgacgtacttctcggcggaccagctgtcgagccaggtgtcctcgacgagccggtacacggcgtcggtgatgtcgccgtacgcctcgtcgccggtcagccaggtgtcctcgtggaagaccggatcggaaagcatgtgcagcgccgagcgcacgttgctgcgccagcgccaccacggcatgtcattgaggggcatgccgcccatggtggaggagcggccgccgcgtcgggaagagttcttcgaaccttgggcgaatgtcacgctttcgatcgtacgttcctgttcagcgcgatcttgaggcgcccacggcgacggcgcccccgcaattcacctggccgtcacccgatgttgtgtccatctcactcgacagttaccagcggggcggaatggtgcatggacatgaccatctcgcgacgcgccgtatccctctcccgcaccttcgtggccacggcgatgggtacgtgcctcatcgccgcgtgcggggcgctccccgggggttccggagggtccggcgggaccgtcaccgtcatgaccttcgcccccgaagagaccaaagcgaccaacatgcccggaatgaccggcatggccaaggcgtacgagcgctacgtgaactccaagggcgggatcaacgggcgcaaactgcgcgtactgacctgcaacgagaagaacacgccctccggtgccgccgactgcgcccgcaaggccgtcgccgagaaggcggtcgccgtcgtcggctcctacagccagcacggacgcgccttcatggccccgctggaggcggagggcatccccttcatcggcggctacggagtctcctccgaggagttccagtcccccctgtcctacccggtcaacggcggccagcccgtcctcatcgccggggccggccaccagctgggccgcgcctgcaaccaggtcgccctggtccgccccgacaccatcgcgggcgacaccctgccggtcctcctcaacgccggactgcgggccaacaagatggcggacgcatccgacatccgggccgccgaggactccgccgacttcgtggcgcaggcccgcgaggccctcgcgcacaccagcggcaccggcaaggagaaggaaaaggagaagggctgcgtgaccgccgtcctcggcgagcgcaccgagaccttcttcgacgccttccgccggaccgacgcccagcgcaagaagccgcagatctcctccgtcctgggcagcgtgagccagtccctcgtggaccgcaccggcggcaaggagagccccttcgagggcgcctacctgaccagctggtacccggtgtccgccgatcccctctgggagcccatgcggaaggtggtctccgagttcgccttcggcgacgacagcgtcgaccccgacgacagcggggcgcagaccacctggatcgcgtacacggtgctcagcgagatcctcaagcgcttcgcgtcggacgcgcccgtcaccggccgcacggtcaagcgggccctgaacgagtcgcagccggtcaacaccggcggcctcaccccggccctgagctggcgctaccaggacatgcgcgccgtcgccggcttcccccgcatcgtcaacggccaggtcaccttccagatcgtgcaggccgggcggctcgtggcacagcccggcgagcagtccctggacatgaccccgaccctggtggcggccccgcccacggcctgatccgaaccggctctcagagctgggtcttgtcccgcttggtgaggccgtacttgccggcgatcgcgttccacagggtcgcggcggactccttggccttcgtcgcctcgccgctggacttgttgccctcggaggcgttcttggtggccttggccttgccgtccttgcacttgtcgtcgtccacgtcgtccgcccaggccgcgtagctgttgtcggcgtccgcggaggactgccaggccttggtcagggacgcggacagcttgacgtggtccggcagctggtccagcttcagctcctggagacgggtgacgagctcctcgcgctggcgggccgcgtcgcgcaggtcggcggccgcctggtcgaggttgctgcaggccttgatgtcctccacggccttgatcaccgcggcccggctgtcgttgctgtccgcgaggaccttgtcgagctggacggcctgcgggcgggccgggtcgaccggagcctcaccgccgggggccgcggatccgccgttcgcggccggggcgtcggcgaccgcgccggggtcgttgttctgcggcttgccgtcggcgagcagcgaaccgacgccgagcccgacgacggccaggccgatgaccaccgccgcgatgatcgcgggcgataccttgcgcgcgggctccgggggcggcgggggcggggcgtactgctgctgcggcggctggtgcggctgctggtactggggctgctgcgggtggggacgcggcgacggccggcgcagcacgggatcctgtacgggcggcaggtgctgcgtctgcccggcggcgtcgtcgccgcggaagagcccgtcgaacccttcggcggcggggaccggcggcatgtactgggtcgccgcctcgtgcacgggggccgccgggaccggcggtatgtactgcgtcgccgcctcgtcgtgcccgggacccgccggcaccggcgggatgtactgggtcgcggcctcatcgtgggccggggcggccgggaccggcgggatgtactgggtcgcggcctcatcgtgggccggggcggccgggaccggcgggatgtactgggtcgcggcctcgggcagcggggggtagccgtagccgtgcggatcccccggcccctcgtagccgggtcccaccacgtgcccgggcacggcctccgcgccggggtaggcctgcgggtatccgtacgcggccccgggctgcggctgctgctcctgcggcggctgctgctgatccgggtacgccggatatccggacgccgggtccggaccccacggggcaccctgctggggggcgcccccttgtccgttctgcgtcaccgggactccttctccgactcgcccgaccctacggaaccgtcggctcacgctacccggtcacgcaccgccaccgggagagcaccccgaaccccaccccggccgaccgaaccggctgcgccgacatccggggcccggggccgggaacacagccccgaacggtcggcgccggacattcctaggccgtcacctccagccgcgccgcgaactcccgcaccgccgcctcctcccggtacggctccagccgcgcccggaagtcgtccaggtactccacgccccggttcgagcggagcccctccagcagctccgccgcctgcgtcgccgtcaggcaggcctgttccacctcccgctgctgcacctgcgccgccgccagcagcagcagcccgatcgcccggcggcgtgccttgcccgccgggagaccccgcagggcctcctccgcccgcctggccgccgcgtccgcctggcccaggtcgcggtggcagtgggccagctcgtccgccaggtacgccgcgtcgaagtggcggatccacaccgggtcgtcacccgactccggctcggcccgctccagcgcgctcaccgcccgcccggacagcaccgccgtcgcccgggtgtccccgagcagcgcgtgcccgcgcgcctcggccgcgtagaacatggcctcgacccgcggggtgacctgcccgcgcgtcccctcctgggcggcccgggccagctgcgcgatctccctcgggttgcccagttcggcggccaggtggctcatggacgctgcgagcacgtagcccccgtacgcccggtcccccgccgcctgggccaggcgcagcgcctggatgtagtagcgctgggccaggcccggctggcccgtgtccaccgccatgtagccggcgagctcggtcagccgggccaccgccgcgaacagggcccgcccgacgggttcccggtacgagccgccgatcagcccggacaccaccgagttgaggtagtgcacgaccaccggcctgacgtgcccgctgccgaagcggtggtcgaggtccttgagcgcctcggtggtcgcgcggaccgcctcgacgtccggcatgccgacccgcgagccgccactgcgggccacctgggtgtcggccccggtgatcagccagtcgcggctcggctcgacgagcgcggaggcggccacgctggagccggcgaggaagtcacggcggccgacatcgctgcgccacagctcgcagacctgctcgatggcgccgacgacggtcggggagaactgcaggccgacccctgaagcgaggttcttgccgttggccatgccgatctcgtcgatcgtgacggtccggccgagtttgcgcccgagcgcctcggcgatgattccgggagcccggccgcgcggctgctggccgcgcagccaccgggccacggaggtcttgtcgtagcggagatcgagaccgtgctcggccccgcacatgttcacgcgccgggctagcccggcgttggagcacccggcttcctggatgagcgcctgcagccgttcgttcggctggcgggcgacgagaggcctggctgccatgaaaaccccctgctgaccgcgggtgatccgttggaatgatcacttcccgcctgatgtgcggagaatcttccgctctgcgtcgtgtcgctacccaactccggcgccccggcctcctacgcgcccccacgcgtgcatcagtgcgccccgtatgcaggatcgatgctccgcccgccgccgggtttacgcccgtaaccccgggtgacccggagagttgtgatgggcgtggaagagaccatcggagtcacggagaccgcacccatccccaagcagcgcggcgagcagctgctggaccatgccgtgcggtacgcggaagaacggcactgggatgtcttcgccggcacctggttggagcccggggacggccgcgagctgtgctcctgcggggccgaggactgcccggcgcccggcgcgcacccggcggtgaaggactgggcggcgcacgccaccggcagcgcggtgcaggtgcgccggatctgggcgaagcacccgcaggcctcgatcctgctgccgacgggccggaccttcgacgcgctggacgtgcccgagtcggccggattcctcgcgctggcgcggctggagcggatggagcgcaccctcgggccggtcacgctcacgcccgaacaccggatgctgttcttcgtcctgccgggcgccggcgtcaaggtgcccgacctggtgcgcaagctgggctggccggccgccacgatcgacctggtggcacggggcgagggcgagtacgtggcggcgccgcccacccggttcggcggccggggctcggtccagtgggcgcggcggcccacgccggcgaaccggtggctgccggacaccgaggagctgatcgacgctctggcgtacgcgtgcggcagtgaggccgcggcggaacgcaagcgccgccagggctgacccggacacccggaccccgccctgccgaccggccgaccggccgacctgcgaaatcagggcgaaaactgatgacataagtaactgctcaagcctctccccctcctcctatggtgaagaaggaacgaccaacggggacgtaatgagaggcaggcgcatgccggaccagggcgatgcgacgggtggaacgtacggaacgggtggcgcgcgatccgcgccgcccgccgtgcgcgtggaaggtctgtggaagcggttcggcgagcaggtggccgtcgccgggatagacctggagctgcccgcggggcagttcatcggcctggtgggccccaacggcgcgggcaagacgaccacgctgtcgatggtgaccggcctgctgcgcccggacatggggcgggtccacgtcgcggggcacgacgtgtgggcggacccgaccgaggtgaaggcgcggatcggcgtactgcccgaggggctgcggctcttcgagcggctgtcgggacgcgaactgctcggctacatgggccggctgcgcgggctgccgggcgaggagaccgacaagcgggcgacgcagctgctggacgtcctcgacctcgcgggctcgcagcacaaactggtcgtggactactcgaccggtatgcgcaagaagatcggcctggcggcggcgctgctgcacaaccccgaagtgctcttcctggacgagccgttcgagggcgtcgacccggtgtcggcgcagaccatccgcggggtgctggagcgctacacggcctccggtgccacggtcatcttctcctcccacgtgatggagctcgtcgagtcgctgtgcgactgggtggccgtgatggccgccggccggatccgcgccgcgggcccgctggccgacgtacggggctccgcgccctcgctgcaggccgccttcctcgaactggtcggcgcacacgggcgggacgcggccggtgactcgctggactggctcggcggcggctccggggcgggatcgcgatgacctcgtcctcgccctcgcccgccaacccggctgccggaacggctgccggaccggccggcaccgtgaccgcctccgcctccggagccccggggcccacggacgccgcaggcgccgcaggcgccacccgggtcccgtccgccgcgtcggtcccgctgaccccggtcttcgtccgcctcaagctgtcgctgctgcgcaacggactgaagggctcctcgaagcgcaaggccgcctacttctcgacgctcgccctcgccctggtcgtcggcttcttcgtgacgctcggcctggccctgctgcacgggaacgcccacgcgggcacggtcgtcgtgctgctggccgcgatcctggccctcggctggaccttcatgccgctgttcttcccctccggggacgagaccctcgacccgagccggctggtcatgctgccgctgcgcccgcgtcctctcgtacaggccctcctcgcctcctcgctggtcggcatcgggccgctgttcaccctgtgcctggccatcggttccgtactggccgtggcacgcggcgcagccggcgcggtggccgcggtggtggccgcgcccctgctggtgctcggctgcgtggccctcgcccgggcggtggccacggccaacgtacggctgctcaccagccgcaagggacgcgacctggccgtgctcagcggcctgctgatcgcggtgggcgggcaggtggccaacttcgccagccagagcctgttccaggcgggtggcctggcctcgctggagcccgtcgaggatgtcgtgcgctggctgccgccggcgaccgccatcggcatggtggactcggcgagcgagggcgcgtacggggtggcggccgcccagctggccctgaccctggccgcggtgatcgccctcctgtggttctgggagcggaccctgacccggctgatggtcaccccggacggctcgaccatcaccgcggcccggccgatgaaggaccgcggcgcgggcggccggtggtccctgctgcccgccggacgcacgggagcgacgatgcggcgcaccctgcgctacgccgtccgcgatccgaagaccaagtcgggctgggtgacctcgctggcgatcggcgtgatcatccctgtcttcaacgccctccagggctcggggtccgtatacctcggctgcttcggcgcgggcatgctcggcatgctgatgtacaaccagttcggtcaggacacctcggcgttctggatggtcgcgcagaccatctcctccacgcgcgacgcgtacgtcgaactgcgcgcgcgggccgccgcgctggccctggtcaccgtcccgtacacggtgctggtcacctcggtcacggccgcggtgatcggcgactggtccgccctcccggcggccacgggcctggccctggccctgctgggttcgatgctctgcacgggtgcgctggcctcggcccacttcccgtactcgatcccgtcggacggcgccttcaagaacgtcgccccggggcaaggcggtctcgcctggggcggaatcctcgccgggatggtggtctcggcgatcgtctccgcgccggtgatcgtcatgacgatctggctcaacgtgggtgaccaccaggacatctcctggatcgtgctcccgctgggtgcggcctggggcacgctggccgcctgggcgggcctgcgactcgcggcccccacggtggcgcgcaagctcccggagatcctgtgggcggtcagcaagggctgaccggcgaccgcgactgccgaccgctgaccggcgaccgcgccggaacgggccgggctccgctccctcacgggggcggagcccggcccgttcccgtcactccggcatcggtcggctccgcggcaggtgcgtcgggtgggtgtcgggggtctcggttttgatgccgtcgaggaagggttccaggacttcgcgccaggccgtcggctggtcgtagtggaggtagtggcccgcgtcggggatttccgcgtactggccggccgggaggacgcggaccatttcctgggcctcggcccggcccagttcgccgtccaggccgcggaccaccagggtcgggcagcggacctgggcgagctcctcccagtgggcgtcgtacacccacgtctcgcgggccgtcagcatctggcggcgggagaagaccggacgccagccgtccgacgcctcgtgcatgacctcggcgaagaaggcgccgcggccgggatcgggccgctccacccgggggtcgtcctcgccgaaccagcggcgggccgcgtcctgggtgggaaagggcagaggccagtggtggaaccagtcctcccactcctgctgggaggccgcgcccagggcggaggcgcgcatgtcgcagatgaccacggcttcgaccaggtccgggcggcgggccgcgagctgccaggcggtgagggcgcccatggagtggccgatcagggtcacgggggcgaggccgagctgctcgacggtggcttcggcgtccgccacgaaggcctcgcggcccagggcggtcggggtgccgccggaggcggcgggcgggcgggcgctctggccgtgtccgcgctggtccagggccacgacgcggcggcgctcgcggagccagcgggcggtgcctgcccagtggaaggcgcggcccatcaggccgtgcagtaacagcacgcccgggcgggtgtcgggctcggcctctgcttcgcggaactcccaggcagccaggcggacaccttcggcccctgtcacatcgacgcgctgtaccaccgcagatgcacccccttcgctccccgccagactatcgaacccatattcgaaaacgggtttctcgtccccaacaccgctctttcgagtgaccttgctcaaggattggccgccactgccgatggagatcctttcaacagggaggcgggccgctcggggaagacggtccgaggggacgaccttgagagctcggggctccaggtcacaaggggaggaccggtcccggcgccgaaaggcgccgggaccgcccacaccaagggctggtcttccatacgggtaacgacccgtgaggcaggaacccccgagtcacggctcgtacggaccggtccaccggacgcatccgcgtcgacgcgggcaccgacgcgaacgccgacgcaccgcggagatcagcgcttcgcgacgaacacgtgcgaagcgacctccacgtccagctcggcggcctcgccgccactgccgaccagcacgccccccggggactcggtcacgctcaccaccgagccgggctgcacgccggcccgccggagcgtgtacatcagctgcgcatccgtctggatcggctcaccgatccggcggacgaccaccgtcttgccctcggaacccgggtcgagctcggacagactgaccatgccgtcctcgaggaacgggtcggcctcggccttctcacccagctcctccagcccggggatcgggttcccgtacggcgactcggtcgggtggcgcagcagctccagcacccgccgctccaccgcctcgctcatcacgtgctcccaccggcaggcctccgcgtgcacctgctcccactccagcccgatgacgtcgacgagcagacactccgcgagccggtgcttgcgcatgacacgcgtagccagtcgacgcccctcctccgtcagctcaaggtgccggtcgctggcgaccgccaccaagccgtcccgctccatgcgcgccaccgtctggctcaccgtcggaccgctctggtcgagccgctcggcgatgcgggcgcgcatgggtaccacgccttcctcttccagctcgaggatggtgcggagatacatctccgtggtatcgatcagtccggacattcgtgcccctcggatagcgtgcgctggccctgcccccaattctgacgcatcgggccgacaaccgtcccgtgccaagggtcaagagccctcacggacatctcccggacatcccggggaagatccaccggagatgcgcggggcgcgcgaccagagctttcggcccgggattgacgttcgtattgacacgcccttggtccagaccgcacggtgagcggcggacacggacgctcccccacccctggaagggccatcggcgtatgagcgagagcaagctggccggtcagttcttcgatgccgccatcggtctgctggagcgcgtgcgggacgaggaggccgcgcacatcgccgaggcaggctccctcgtcgccgacgcggtcgcctccggcaaccggctcttcgccttcggcgccgggcactcctcgctgcccgcccaggacgtcgtctaccgggccggcggactggccctgatgaacttcctcgccgtccccggcacggccggcatcgacgtcatgcccgcgaccctgggcagcgccctggaacgggtcgacggcctggccggcgccgtcctcgacagcagccccgcctccgacggcgacgtcctcgtgatcatctccctctccggacgcaacgccctgcccgtcgagatggcgatgaacgcccgcgccatcggcctcaaggtcatcggcgtgacctcggtggcgtacgcgaccgggaccaagtcacggcacctctccggcaccttcctcaaggaccactgcgacgtcgtcctcgacagcaagatcgcggtcggtgacgccgagctgagcatcgacggcatcgacgcgcccttcgcccccgcctccaccgtcgtgaccagcgcgatcatgcaggcggtcatggcggccgcggccggcgagctcgcggcccgcggggtcgagcccccgctgctgcgctcgggcaacgtcgacggcggccacgagtggaacggccgcgtgatgcaggagtacggcgaccggatcttcttccggcactgagccccacggcgcgggcgcgcgccgcgccatcagcccccgtccgggccggccggacccgccgccaggtccaggtcggccgcgacccgggccgcgacctcctccgcgtacgccgcgtccgcgcgctcgaaggccacccgcgagggtccgcgcaggaacgtcagcgcccccagggtccgcccccggctccgcagcaccgtgcacagcccgtgcgcggcgtcctcgggccaccggcgggcccgcgcccactccgcgtccgcctccccgcgcggggcactcgtacgcaccgagccgatccggtccagggcctgcagcgccgggtgcccggccgcgtaccggaccgggatcgaccccgggcccggcagcgccggcggcgacgcggccgaccgtacgagccttcgccgctcgggatcggccgtcgggtccagtacgtccagcagcgcgtgctccgcgaagccggccagggcgaagtccaggcgtacggcggccgcctcggccgggtcctcgcactcggcggcggcccgccccgcgcggtggagctggtgcgagcggaaccgcagctgcgcggtgtccagctgctcctggcgggcctcggtgacgtcctggaacagccagccgacgcccagcggtaccggctcctccgcgagcggcgaagccagccgcaggaacccgcaccgccagcacctgcgccgcaccccctccggcgtgcgcaccgacacccacatctccaccggcgcggacggggccccctcggcgagcacgtactggagcgcgccctccaactcctcgacgccctggaccagcagttcccccaggggccgcccgaggagcgcggtgcggccggccccgaaggcccgtgcggcgtgcgcgttgaccacggcgggccgcagatcgacgtcgaccaggaccacgccccacgaggcgtcctccagcagggcctcgctcagcgcgatggagcgctccaggtcgatctgggcgtgcacctcgctgaaggcgcagtacaccccggcgggtttcccgtccgcaccgggcaccccggcggactgggtccgcacgaggacgcgcccgccgtccttggtcagcagcgcgaactcgtgcacctgccggccgggcacctgccgggcggccatcagccggtcctggacgtcgtgcgcgtcggcggcacgcaccgcccacccctcgaagcccttgcgccccacggcctcggcggcggtccaccccaggatccgctcggcctcgcggttccagtgggtgatcaccccgtcggagtcgaacgcgcacagggctgcgtccatcccgtccaacagcgcggcgagcagatcgtcagcggtctcgttacgcccgtaagcactcacctggaacccccagcaggtgttcgcgtatgcggcacgtcagatcattgaactcgaacgtgacccacaccacaccgctttcgccggattagggatacgaaatccggtcaggccggtccgccgagccatgtcgtgaggacgatccccgcgaggacggcggcggccacaccgaagatgagcacgtacgaccgccacccgtcgaaccaccggtcccaggcctcctcgcgcgcgttctgcagggcgatacgcggctccgcccgcggatcggggacccggccggcgctccgccgccgcaccaggagcgcccgcaggaaggcgagctccggctccagggccgggagctcctcgtcgtccacacacagcaacaggacgcgccggccgtcggtgcggtaggcatacgtgacggtgccgggcccccagccgcgtcccgcggggacggccacgcaccggatgtcgtggatgccgtcccaggcgaggcggcgcggcgggcgcaggccgcgcacgacgatgccctcccggtcgacgagagcccggccgagaccgtgccgtagaagcaccagttccgggccctgtgcccgtagtggcgtggaagggccccgtggtcgccgtccgtgtgtcccccgtgccgatcgctcccgtgggggcatcctcgctcgcggtgatcgagaaataaaacgcttgtggccgtcggtgcgcctgcctaggctctgacttacacgagaagggaggtggttcccgaaatgtacggaaaccggacgcgtgaggtgactgcgggctaagcgcccgtcgtcagcaacgcacccagtgcggtgcccggcggaacgcctggcgccaatcccaagcagtcacccgacccgcgggctcgccggtacgtccggccggcttctctcactgcaggagagaaacccgagcccgcgggtcgtctgcgtgtaccgccccggcgccgcacggctacgggcagagccggtccacgtgccactcctccccgtccagggtgtagcgcagccggtcgtgcaggcggttctcgtggccctgccagaactcgatctcccgcggcaccacgcgcaggccgccccactccggcgggaccggcacctgctcgccctccgggtagcgggcctccagctcggcgtagcgccggtccagctccgcgcgggagccgatcacgctcgactgctcgctcgcccaggcgcccagctgggagccgtgcgggcgggagcggaagtacgcggccgtctcgtcacggccgatacgggacgccgtaccggtgacgatcacctggcgggcgatcggatgccaggggaagagcagcgcgacgtgcgggttctcggccagctcgcggcccttgcgggaggcgtagttggtgaagaagacgaagccccggccgtcgaactgcttcatcagcaccgtccgcgaactcggccgtccgtcggaggtggccgtcgatacgaccatggcgttcggttcgaagaggtgcgagtcggcggcctgctggaaccagagggcgaactggtccatcggattcccggcgagactgccctcgtcgacgatctccgagcggtactgcttgcgcatcatggcggggtcaatgtcctgatcggtcacgcgggccatcctgccgcagccggaccggtgacggtgtgccgtatgtcacgcttccgcagtcggggcggaacggccaaaatcttggggccggtccgaaggtccccgagcgggtgaccgacggccgtgccgggcatcaacggggatgaccgcgccggaccgcgagtcacgccgggagccgcgcgtgttcgcactatctgaggagccgcctgatgtccgacttcgtacccgggctcgaaggggtcgtcgcgttcgagacggagatcgccgagcccgacaaggaaggcgggtcgctccgctaccggggcgtcgacatcgaagatctcgtcggccacgtctccttcgggaacgtgtggggcctgctggtcgacggtgctttcaacccgggcctgccggccgccgagcccttccccattccggtccactccggtgacatccgcgtcgacgtgcagtccgcactcgccatgctcgcccccgtgtggggcctgaaacccctgctggacatcgacgagcagaccgcccgcgacgacctcgcgcgcgctgccgtgatggcactgtcgtacgtcgcccagtccgcccgcggccagggcctgcccatggtcccgcagcgggagatcgacaaggccgagtccgtcgtcgagcggttcatgatccgctggcggggcgagccggacccgcggcacgtcaaggccgtcgacgcgtactggacctcggccgccgagcacggcatgaacgcctccaccttcaccgcccgggtgatcgcgtcgaccggcgcggacgtcgccgcggcgctgtcgggcgcggtgggcgccatgtccgggccgctgcacggcggggcgccgtcccgcgtgctcggcatgatcgaggagatcgagcgcaccggcgacgccgtggcgtacgtgaagaaggccctcgacaagggcgagcggctgatgggcttcgggcaccgcgtctaccgggccgaggacccgcgcgcccgcgtgctgcggcgcacggccaaggagctggacgcgccgcgctacgaggtggccgccgcgctggagaaggccgcgctggaggagctgcacgcgcgccgccccgaccgggtgctcgccacgaacgtggagttctgggcagcgatcatgctggacttcgccgaggtccccgcgcacatgttcacgtcgatgttcagctgcgcccgtaccgccggctggtcggcgcacatcctggagcagaagcgcacgggccgcctggtgcggccctcggcccgctacaccgggccggggcggcgcaacccgcaggagatcgagggctacgcggacatcgccgagaccgcgtaaccgccgctcgctcagggcgccgtgtcccgttcgcggggtacggcgcccttcgcgttcccgcgcgtcagcccagggccgcgtcgaggatgcgcgaccactgggccaccacccgggcgcggcgggccgtgtcgtcggtgagtacgttggccaggccgagcccccgcgccatgtccagcaggccctgcacggtctcccgtacgcccggcaccgactcgtcagcgcccagcagctcgacggcgatgcggtgggtctcgcggccgacccgggcctccagctcggtgacccgcgggcgtagctgctcctcgttggaggcggccacccacagctggagcgcggcccggaagagggctccggtgtacaggtcgaccagcgcctccaccacggcggggcgggcggccggtccggcgtggaagaggtcgcgcagggcggtggaccgctcctcggcgacgtactcgacggccgcggtgaacaggtcctcgcgggtcgggaagtggtgctgggcggcgccgcgcgagacgccggcccgttcggcgacgaccgagacggtcgacccggcccagccgtgctccgccaggcaggacacggccgcctccaggaggtggcggcgggtgacacggctgcgggcctgcttggggccggtcacagcgaccatgacggttcccggcgctcgaagcgggcggtgatgccctcgcgggcctcggcggaggcgaacagtcctgcggacagctcggtgaggcgggagccgtcgcgggtgagggcctcgcgcacggcggcggaggtcagcgccttggtcgcggccagcccctgcggggaggccttgcgcaggccggcgagtacgggctccagggccgcgtccacgtcctcgccgtgcagggtgaggaggccgatccgggcggcctcggcggcgtcgaaggcctcggcggtgaggaagtagcgggcggcggcgcggggttcgaggcgcggcagcagcggcatggagatcacggccggggcgaggcccagatgggtctcggtgaaggcgtacgaggactgcggtccggcggcggcgatgtcgcaggcgccgagcagcccgaggccgccggcccgtacgtggccggtgacgcgggcgacgacgggcttgggcagctcggcggtctcgcggagcagcgccaggaagtcggccgggtcgcagggggacttgaggtcggccccggcgcagaaggtgttgccggtgtgggtgaggacgacggcccggacggcggtgtcggcggccgcggcggcgagcgcggagcggaggtctgcgacgaggtctgcggagagggcgttgcggttgcccggggagtccagggtgagggtggcgatgccggtcgcctgggcggcgtgcacgagtggggccatgtctcctccggagtggtgtgcggatgggggtgcgtggggagccgagtcccctccggggagggtacgtgttcccctgcggggtgctcggtggtgtgcggtacgggccgtcccggcccgggtgggccgtgcccctgcggggtgctcggtggtgtgcgggccttcccgtgccgcggggtgcgcctcaagcgccggcggggctggggggtgtggggcggggccccgcacgagggtctcctcggctcgcgcctgcggccggggtctagttggacggcctgggttgcgcgctcgtcctgcggggaccctcctgcgtgtccccgccccacggcagggcttcgacggacacctgggcggcggggtggggggacgtggcggggtgtccccgcaggacgagcgcgcaaccaccccgtatggctggaccctgcccgcaggcgcgagccgaggagacaccccggcgcggcaccccgccccgccccagaccgacaggcccgcacaccccagccccgccggcgcttgaggcgcacccccggccgggacgacccgcacaccgccgagcaccccgcaggggctgacgcaccgtcagtaggacttcggcaggtgcagggtttggtgggagatgaagttcaggatcatctcgcggctgaccggggcgatccgggccacgcgggaggcggtgatcagggagcccaggccgtattcgcgggtgaggccgttgccgccgagggtgtggacggcctggtcgaccgcacggacacaggcctccgcggcggcgtacttggccatgttcgccgcctcgcccgcgcccatgtcgtcgcccgcgtcgtacagggcggccgccttctgtgtcatgaggcgggccagttccagttcgatgtgggcctgggccagcgggtgggccacggcctggtgcgcgccgatgggtgtcttccagacctggcgggtcttcgcgtactcgacggcgcggccgagggcgtagcggcccatgccgatggcgaaggcggccgtcatgatgcgttcggggttgaggccggcgaacagctggagcaggcccgcgtcctcgtcgcccacgagggcggaggacggcaggcgtacgtcgtccagggtgagttcgaactgcttctccgcggccgccagttccatgtcgatgaccgtgcggccgaagccgggggcgtcccgcgggacgatgaacaggcagggcttgaggcttcccgtccgggcgtcctcggtgcggccgacgatgagggtggcgtcggcgatgtcgacgccggagatgaagaccttgcggcccgtgaggatccagtcgtcgccgtcgcggcgggcggtggtggtgatccggtgggagttggatccggcgtcgggttcggtgatgccgaaggccatggtgcggctgccgtcggcgaggccgggcagccaggtctgcttctgggcgtcggtgccgaagcgggcgatgaccgtgccgcagatggcgggcgagacgaccatcatgaggaggggacagcccgcggcgcccagttcctccaggacgatggagagttcggcgattccgccgcctccgccgccgtactcctcggggaggttgaccccgaggtagccgagcttcgcggcgtcggcccacagctcgtcggggtggccgccttcgcgggcgatccgggcgaggtactcgcggccgtagcgctgtccgagggcggcgacggcggcgcgcagggcgtggtgctcttgggtttcgatgagggtgctcatgcttgcgtttcctcctggactacggcgagcagggcgccgtactcgacctgttggccggtggcgacgtggagcgcggtgagcgtgccggaggcgggagcgagaatgcggtgctccatcttcatggcctccagccagagcaggggctgcccggtggtgacggggctgccggggacgaggccctcggctatgcggacgacggtgccgggcatgggggcgagcagcgagcccggttccgtgcggtcctggggatcggggaagcggggaacgcgggtgaaggtgtgggcgccgagggcggagtccacgtagatctcgttcgaattttgtttcacgtggaacgcccggcggattccctcgacttcgagggtgacgaggtcgggggtggcggccaggacccggatcccggggtggttcaccgggtggtactggacctcgtactcggtgccggcggtccggtagcggcgggtgtgggggtgcgagcggaggttgcgccagccgcccaggcgggcggcgaggggggcgtcaggggcaggggccgcctcggcgagggcggcggcgagggcggccggggtggggtccggggcgccgccggtgagggtgtcgaggtggcggtcgtagaagccggtgtcgagctgcgcggcggcgaattccgggtgccgcagggagcgtacgaggagttcgcggttggtggtgagcccgtggaggcgggctccggcgagggcggcggcgagggcgcggacggcctcggcgcgggtgggggcgtgggtgacgaccttggcgagcatggggtcgtagtggatgccgacggtgtccccgtcggtgaacccggtgtcgacgcggacgccgccggggatggcgagggtgtgcagggtgccggtctgggggcgccagtcctgggcggggtcctcggcgtagaggcgggcctcgacggcgtgtccggtgggccgcgggggtgtcgggggcagcgccgtgccttcggcgacgcgcagctggagggcgacgaggtcgagatcgaatacggcttcggtgacggggtgttcgacctggaggcgggtgttcatctccaggaagtacgggcgtccgtcggcggtgacgaggaactcgaccgtgcccgctccctcgtacgagacggcgcgggcggcggcgacggcggcctcgtggagggtcgtgcgcagggtttcggggaggcccggggcgggggcttcctcgatgaccttctggtggcggcgctggagggagcagtcgcgggtgccgagtgcccagacggtgccgtgggcgtcggcgaggatctgcacctcgacgtggcggccgcgttcgacgtagggctcggcgaagacctcgccgtcgccgaaggcggagcgggcttcggcggaggccgcgtccagggcttccttgagctggtcgaggtcgcggaccacgcgcatgccgcggccgccgccgccggccgcggccttgaggaggaggggcaggtcggcgtgggtggcggtggcggggtcgacggggtcgaggagcggcactccggcggcgcgcatcagttccttggcccgggtcttggaggccatggcctcgatggccgcggggggcgggccgatccaggtcagtccggcggcctggacctcgcgggcgaagccggcgttctcggagaggaagccgtagccggggtggacggcgtcggcgccggcggcgagggcggccttgatgatcaggtcgccgcgcaggtaggtgtcggcgggggccgcgccgggcaggcggacggccgcgtcggcgtcgcggacgtggagggcgtcggcgtccgggtcggagtggacggcgacggtggtcaggcccagggcgcgggcggtgcggaagatccggacggcgatctcgccgcggttggcgacgaggagggaggtcaggttcgtcatgtgcgggctcacatccggaagacgccgaagccgccacgggcgccctcgacgggggcgttgtggacggccgacaggcacaggccgaggacggtacgggtgtcgcgcgggtcgatgactccgtcgtcgtagatccgtccggacaggaacatcggcagggactcggactcgatctgcgcttcgacgaaggcgcgcatcccggcgtcggcctcctcgtcgtagggctgtcccttggcggcggcggactgccgggacacgatggagagcacgccggccagctgctggggtcccatgacggcggatttggcgctgggccaggcgaagaggaagcggggctcgtaggcgcggccgcacatgccgtagtggccggcgccgtagctggctccgatgagtacggacaggtgcgggaccttcgagttggagacggcgttgatcatcatcgagccgtgcttgatgatgcctccctgctcgtactccttgccgaccatgtagccggtggtgttgtggaggaagaggagggggatgtcgcgctggttggcgagctggatgaactgggcggccttctgggactcggcgctgaacagcacgccctgcgcgttggcgaggatgccgaccgggtagccgtgcagggtggcccagccggtgacgaggctggggccgtagaggggcttgaactcgtcgaagtcggaggcgtcgacgatccgggcgatgacctcgcgcgggtcgaagggggtcttgaggtcgggcgggacgatgccgaggagctcctcggggtcgtggaggggttcctcggccttcggcgggtcctggtggggcttgcggtggttcaggcgggccacgacgcggcgggcctggcggatggcgtcgtactcgtcgagggcgtagtagtcggcgagtccggaggtgcgggcgtgcatgtcggcgccgccgagggactcgtcgtcgctctcctcgccggtggccatcttgaccaggggcggaccgccgaggaacaccttggaacggtccttgatcatgatggtgtggtcggacatgccggggatgtacgcgcctccagcggtggagttgccgaagacgaccgcgacggtcgggacgccctcggccgagagccgggtgaggtcgcggaagatcgcgccgcccgggatgaagatctccttctgggagggcaggtcggcaccgccggactccacgaggctgatgacggggaggcggttctgccgggcgatctcgttggcccgcagcgccttcttgagggtccacgggttggaggcgccgccgcggaccgtggggtcgttggcggtgaccaggcattcgacgccttcgacggtgccgatgccggtgaccatggaggctccgacggggtagtcgctgccccaggcggcgagcggggacagctccaggaacggggtgtcggggtccaggagcagctcgacgcgctcgcgtgccaggagcttgccgcgggcctggtggcgggccgtgtacttctctccgccgccctgcagggccttggcgtgctcggtgtcgagggcggcgaggcgctccagtgcggccgtacgggcgcgggtgtgctcgggggcgtgcgggtcgacggtggtgccgaggcgggtcatgaggtggcctccggggccgggaggagtgcgacggggatgtcgaggtggcgggcgcggagccattcgccgagggccttggcctgggggtcgaagcggtggccggaggcgacgccgtcgccgaggatgccgttgacggtgaagttcagggcacggaggttgggcagttcgtgccgctgtacggcgaggccgcgggtctcggggagcagggcctggaagcggtccacggtcagggtggcgcggagccaggcccatgcgggggcggactcggtccagacgccgacattggcgtcgccgcccttgtcgccgctgcgggccccggcgatggccccgaggggcgcgcggacggtctcctggggctccgccccggacccgacgggggctgcgccgccgaccccctcgggggctgtgcccccggccccccgcgcctcacatgcaggcggggccggggcggccggaggggccggggcgggaatcgggacgcgggtgccgtccgggaggactgcggtgtgggcggcgtccgctgcgggggcggaggccgaggcgaagacgccgtagggctgggccgcgccgggtggggcgctgacgtggaagcccgggtagctgccgagggccagttcgatcgcggtcgaggtcagggcgcggcccacccggtccggggacgggtcgcggaccacgagccgcagcagcgcgccggccgtctcctgggtgtcggggtcctcgtggtcggtacgggccagggtccaggtggtgtcggccacgccctccagcgcctcggcgagctgggtgcggacgaggtccgccttggcctcgatgtccaggccggtcaggacgaagacgacctcgttgcgccagccgccgatccgggtgacgccgaccttgagggtaggcggcggggcctccccgcgcacgccgtcgatgcggacgcggtcggcgccctcgtcggtgagccggacggtgtccaggcgggtggtcacgtccgggccgaggtagcgcacgccctgggtctcgtagaggagttgggcggtgacggtgccggtggtgacggctccgcccgtgccggggtgtttggtgatgaccgccgagccgtcctcggagatctcggccagcgggaagccggggcggcggacgtcgtgccgggcgaagaaggagtagttgccgccggtggcctgggtgccgcactccaggacgtggcccgcggccaccgcacccgccagcctgtcgtagtcgtccggggcccagtcgaaccaccaggcagccgggccgctgaccagggccgcgtccgtgacccggccggtcaccaccacgtcggcccccgcccgcaggcaggccgcgatcccggcgccccccaggtaggcgttggccgtcagcgcaccgtccacccgcgcggtgaggtcgtctccctcgacgtgcgcgacccgcacggggacgcccgccttcgccgccagggcccgtacggcgtcggcgagtccggccggattgagaccgccggcgttcgcgacgatgcgtacgccccgctcgtgggcgagcccgaggccctcctccagctggcgcaggaaggtcttggcgtagccgaggtcggggttcttcaggcggtcgcggccgaggatcagcatggtcagctcggcgaggtagtcgccggtcagcacgtccagcgggccgccggtcagcatctcgcgcagggcgtcgaagcggtccccgtagaagcccgaggcgttgccgatgcggagcgggcgccgggtcaccgcgcggcccccggctcccggcccgccccaggctcccggcccgcccccgccgggccggcgaaggcctgggcgatgtccagccagcggtcggcgtcggggccggtcgcggtcagggccaggtcggcgcggtgggcccgctgggtcaccaggaggcagaagtcgagcgccgggccggtgatccgctgcggggcctccggcgggccgtacgtccacacctgcgggccgtcgggtgccgtcagctccacccggaactcctcggcgggcgcgggcagtccgcgtacggcgtaggcgtagtcgcgggcccgtacgccgatccgcgccacgtgccgcagccgcgcggtcgggatacggcgcacgccgagcgcgtcggcgacgtcctggccgtgcgcccaggtctccatcagccgcgcgctggccatcgaggcggccttcatcggcggcccgtaccaggggaagcgggtgtcgggcgaggccgcggccagcgcctggtcgagggccgcgcgcgtgctgcgccagcgggcgagcagctcgtcgggggccagctccgcgccctcgcgcgcgccttcgtcgacgaacgtgtcgggggccttcagggcctgctcgaccatgtggccgaagccggtggcgtcggtgagggagagcagtgaggcccggtcggtccagtgcaggtgggcgatctggtgggcgatggtccaaccgggtgcgggggtgggccgggcccagtcgggaatgcccaaatcccctaccagggagtccagttcgcggccctcctcgcgcagatctgcgaagacggcgacggctgcgtcgacggcggacggatcgggcacggtgtgctcccctctcggcgtgaggggaagactggcagcacccaccaaaacaatcaagcatgcttgcatgattttcttcggtggcgacgtcttcccgccacccggaccaaaccgccccgggggaacgccagttgccgcgcccgcatacgggccgcaggtcccgccgcacggcggcccgcgggaacggagggggcgattcaggccgtaagccggaaactcgcgatacgtcactggatgtcccgtcgatactgaacgttccgctccgggcccgggcgggcgcacacgttcctgtcactcgacgaagacgacgaacgccgtcaaagacgacgcagacgtcgaagacgatgaagaggatggaccgacgtgactccagccgcccgtacccccttctcccgcactcccttctcgctctatcccgaactcgacacgaccgccctcaccgccttcgtcaccgccctggagagcggcgacgtcaccggcctcgcccccgcccgcgccgccgaggtcgccgaggtccgctcggtcgccgtcttcacccgcggcaaggtcaccggcgccgacggggacctcctcgacgccgcgctctggcggcacaccggcacccagccgcgccccgcgatcatcatgccctcgccgtggaccagcctcggctggctcccgtacgccgtccaggcctccctcttcgccgcccgcggctacaacgtcctcgcctactccgcccgcggcttcggcggctccgagggccaggtcgacgtggcgggcccgctcgacgtcgccgacggcagccgggccctggagcacctcgtcgagcgcagctccggcccggtgacgaagatcggcttcctcggggactcgtacggctccggcatcggccagctcgtcgccgcgcacgacacccgcgtcgacgccgtcgtcgcgctcagcacctggggcgacctcggagaggccttctacgagaactccacccggcacatcgcggccgtacgggccctgctcgacgcggccgcgaaggcccggctgagcccgcagacgcagagcgtcttcgacaacgtcctcgccaaccgcgacgtccagggcaccctgcgctgggcggagacgcggtcccccttcagccacatcaaagagctcaaccgccgccaggtgccggtcttcttctcgcacgcctggcacgagacgctcttcccgcccaaccagacgctgaagatgttcaacgaactgaccggccccaaacgcctcgccgtctccatcggggaccactccggcccggagatgacgggcatgctcggcctgcccaaccggatctggacggacgcccaccggtggctcgaccaccacctcagggacatcgacaacggcatcggcgccgaggggcaggtactcggcgaggtcatgtggagcaaaaccctcgaaccccgccccacctggccctccctcaccgaacgcctggaacggctgcacctgacggacgacggcgaactcggcgacgaaccgcaggccggctggacgtcgaccgtgctgtgcgggatggacaccccggcgaccgtcgccgacgcggtggtgcggtccggctacgcggagatcgccggccgcccgaagatctaccgcacccaggacatcgaccgcaccgtcgccgccgtatggaccgcggacccggccggggagaccacccggctgcgcggcataccgcggctgcgggtgacgtaccgggcggcgaaccccgggtccaccttcgtcgcgtacctcctcgacacggcccccgacggcacggcccacatcatcacgcacgccccgtacaccgacctcgactccccgcccgacagtctgatcagcgcggacatcgagctccaggccacggcgtacgacgtgccgcgcggcaaccggctgatgctggtgatcgacgcccgcgacccgttctacggcgacgccaaccacccccgcgcgaccctggacttcacctcccccgaggccaccccgtcctacctggacctccccctcggctgacccatgggcccgtgggcccgtgggcccgtacgcccgagcgcccgcgtcgggccgggcgggggggcgggagccgggcgggcggggtcgggtggtggggcggtggctacggaagggcggtttcgctcgggcggtggtcagtgatgtgtatgggggtttcccgtcagtctcatcgtctctccgtgtcgggccggtccctcaagggcgctccttcgtcgcgtcgcttcgcgatggccttcggccacccttgaccgaccgtcccgccccggaaatccgaagactgccgagaagcccccaaaagaacgagccggtccaggctttgaaggacggggtagccagagaccccctgcccggacgggggccggggacacccgacagacggggcccatccagaccccagcccggaccgggggaagcgcaccacatcgctacgcgctcctcacgtctcagcgtccgacgaccgtcctgggctggacataggccgcccacagcctcaaatccggcgctcgacctgcgtccgacgaccggccggggctgctcataagccgcccacgaccgatgtgcttcttcgggcctgcgtccggcggccggtttggtgctgaagagagccgctgagagggactgacggccggtacctcgcctattccgtcgtggaaccgggtcaacgcgagcacaacaccacaaacccacccccaaacgagggtaattagggcaaactggcggccttctgggccacccacatgcgctgacctgtatccacgacgaaatagccgcagtcccacgccttttcaccccgaacgacggccagacgcagccaaaaaggaccctcatgcgcctgggcgggctcgccgaccgccgaccgccgccaaaagggagccccccaacgggcgtgggcggctcatgaccagccacagacggtcgtcggacgccgtcatcgagagacccgtgagtggtgggcggcccatgcccagcccaagacggtcatcggacgccgagactggggagtcagtggggatggtgggcggcctatgtccaacccaggacggtcgtcggacgctgagaccggggagtcagtggggatggtgggcggcctatgcccagcccaagacggtcgtcggacgctgagaccggggagtcagtgggggtggtgggcggcccatgcccagcccaagacggtcatcggacgccgagactggggagtcagtggggggtggtgggcggcctatgtccaacccaagacggtcgtcggacgccgagagatgaggagcgcgtagcgattggacgcgcctccccgacccgggcggcggctgtcatgggccccgtctcgggagcgtgcccacccgggaccgggcagggggtctctggccgccccgtccctgtcttgagtgcccggctcgttcttttgggggcttctcggcagtcttcggatttccggggcgggacggtcggtcaagggtggccgaaggccatcgcgaagcgacgcgacgaaggagcgcccttgagggaccggcccgacacggagagacgatgagactgacgggaaacccccatacacatccctgaccaccgccccagcggaacagcccctccgcagccaccgccccaccacccgactccgcccgagcggctcccgccctccagcgccgccgccccgcttcccggttccggccgcctgaagctcccgcacaccgaagccccccaccacccagcggccccgccccgcagcgcaccgccccgccgccgcggggccggcgggatgcgtaccccctcagcaggcctcgccgcgccccgcccgggccgtcgcgcgcaggaggtcgcgcaggaggtcgaagtcgaccttggcggggttgcggaagcggaggcatgccttgcccatgtcgtgggcggccaggcggtccgcgaaggcgtcgcggacgtccgtgcgcagcaggtagaaggagatgtactgcttctggttcgcccaggcgatctcgccgtcggtcccgcccgcccgcacgtacaccggcatcccgtacgcgatccgctcctcgaacccggtgagttcctccaggcacagcgcccgcaggcgtacgagggcctcgcggcgggtctccgggaccgcggccaggtaggtggcgacgtccatcaggcggtggccttcttgcggatctgcgagcggaccgcgcccatgctggccgcgatgacgagggcgatggccagggcgtccagggcggacatggcctggttcaggacgaggaagcccgcggtggcggcgatggccggctccaggctcatcaggatcgcgaaggtcggggccggcatccgccgcagtgcgagcagttccagggtgtacgggaggaccgaggagaggacggccacgcccacgccgagggcgagggtgctcgggaccagcaggtccgagcccgcttcggcgatgcccagcggcagcgagatgaccgcggccacggccatcgccagagcgagtccgtccgcctgcgggaagcggcggcccgtccgtgcgctgaacacgatgtacgccgcccacattgcgcccgctccgagcgcgtaggccgcgccgagcgggtcgagggagccgaagccgaggccgcccccgccgtgcccggacagcaggacgacgccgccgagcgcgaggccggcccacaggaggttgaccaggcgccgggagacgacgacggagaggacgagcgggccgaggacctccagggtgacggccgggccgagcgggatccggtcgatggcctggtagaagaggccgttcattccggccatggcgacgccgaaggcgagcacggtgccccagtcggaacgggagtagccgcgcaccttcgggcggcacaggagcagcagcacgatcgcggcggccgcgaggcgcagggtgaccacgcccgcggcgcccgccctcggcatgatcatgaccgcgagggcggcgccgaactggaccgagatccccgccgagatcaccagcgcgacggggccgagcccggacgcggagccggaaccggaacccttggtcggcggcggggtcgtagtggtgacgggggccgtcggggtcgtcggagtcgaagaggaaggtgcgggcatttatccagactaaggccaggtaaggggtgttgtcgcatgtcttgccttacaggcctgtctcacagcccctcggccaggagttccgccaggtgacgggcccgggctccgccgagctgggcgatctgcgtgcggcacgagaatccgtccgcctggatcgccgtgcccggcggagcggtccgcagggacgggagcagctgttcctccgcgcaggccaccgacacctcgtggtgtccgggctcgaagccgaagttccccgcgaggccgcagcagccgccgctgagctcgcccaccagcccggcccgctcccgcagccgccggtcggggccgtccccgagcaccgcgtgctggtggcagtgggtctggccgacgacctcccggtccaggcggggcggccgccagtgcggggcgtactcctccagggtctcggcgaaggtccgcaccgcggccgcgaggcgggcggcgcgggggtcgtcggggagcagggcgggcaggtcggcgcgcagggccgcggcgcagctcggctccaggaccacgacgggcccgggcacctcgcccagcgcgtccagtgtccggcgcaggaccgtgcgggcgcggtcgaggcggccggtggagacgtaggtcaggccgcagcagaccgtgcccccgcgggggacgtcgacgtccaggccggccgcccggagcacgcggaccgccgcgcgcccggtctcgggggcgaggtactccgtgaacgtgtccggccagagggtgacggacctcccctgccccggcggccccgatttcgccgaccgccgccaccaccgcgtgaacggctcgcgcgccagctccggcaggcgcccgccccgctcccggtccagccccggtacggggacgcgcctcgccacggcgttcaccgtccccgccgcccgcaggcgggcgatcaggcgcagccagcccgggaggccgcccagcgtgtagtgggacagcgggcggatccggcccgaccagtgccggtgcaggaactccgccttgtacgcggccatgtccacgcccaccgggcagtcgctgcggcagcccttgcagcccaggcacaggtccagcgcctcggcgacctccgccgagcgccagccgtcggtgacgatctccccggccagcatctcgtgcagcagccgggcccggccgcgtgtggagtgccgttcctccccggtgacccggtacgacgggcacatcaccgaggcgccgcccggatcggtggtccggcacttcgcgacgcccacgcaccgcgcgacctcgcccgcgaacgaggtggcgggcagcaccgcgaagcgcaggttctcgtccagccgcgccggtctgaccagcatccccgggttcatgccgcccgccgggtcccacacgtccttgtacgcgccgaagagccggaccacgtccgccccgtacatcctgggcagcagttccgcgcgggcctggccgtccccgtgctcccccgacagggagccgccgtgcgcgaccacgagatcggccagttcttcggagaagtcccggaagcgggcgatgcccgccgcggacaccaggtcgaagtcgatccgtacgtgcacgcagccctccccgaagtgcccgtacggggatccgcgcagcccgtgggcggccagcagggcgcggaactccctcaggtacgcccccagtcgggccggcggcaccgcgcagtcctcccatcccggccaggccatcgtcccgtcgggcatgcgtgtcgccgtgcccgccgcgtcctcgcggatccgccacagcgcgcgctgcgccgccgggtcggtgaccagcagccggtccaccgcgtcggcggcccgcagcagggcccgcgccgcgccctcgtcgggcatctccgcgaacagccacgccccgccccggggcagctgcgaagccgcaccgccgaccaggtcctcggccatcccctccaccgtcagcgggccgtacggcagcagtccggcggccgcctccgcggccgcgctctcgtcggcgtacccgagcaccgcgagcaccggtgcgcgcggcgcctccaccaggcgcaccaccgcctccgtgaccaccccgagggtgccttcgctgccgcagaacgcccgtgccagctggaccccgcgctcgggcagcagcgcgtcgaggccgccgtagccggagatccgccgcgagaagccgggcggcatcccggtgcgcagcggcccgagatgtgcggtgaccaggtcccgcaggcccgcgggggcgcctgaccagccggttccgatgcggtgtgcggtgcccccgtacgccgtgacggccagctcggtgacgttgtcggcggtggtgccccaggccaccgagtgggccccgcacgcgttgttgccgatcatgccgccgagggtgcagcgggagtgcgtggaagggtcgggcccgaaggtcaggccgtgcgggcgcacggcgtcccgcagccggtcgaggacgagtccgggctggaccacggcggtccgggcctccgggtccaccgacaccagggcgttcatgtgccgggtgaggtcgaggaccacgcccacgccggtggcctggcccgcgatggaggtcccgccgccgcgcgggacgaccgggaccccggccgcggcgcacaccgcgagggcggcggccacttcgtcggcgtcgcgcggggcgaccactcccaccggtacgcgccggtagttcgaggcgtccatggtggtcagggcgcgcgcggcggcgccgaagtcgacctccccgcgcaggttctcccgcaatgtccgttcgagttcaccgggtgacgtcaccactccaccctgccaccgcccggaaccgtctcatcgggtggacgcgcctcagagccgcggaccgggacccgatacgctccgctcgtggctgagatccagattcccgctgacatcaagcccgccgacggacgcttcggcgcgggcccctccaaggtgcggaccgaggcgctggacgccctcgccgccaccggtacctctctgctcggaacctcacaccgccaggccccggtcaagaacctggtcggatcggtgcgccagggcctccgggacctcttctccctccccgagggctacgaggtgatcctgggcaacggcggctccaccgccttctgggacatcgcgaccgccggtctgatcgagcagaagtcccagcacctcaccttcggcgagttctcctcgaagttcgccacggccgcgaagctcgcgccgtggctggacgcgccgtccgtgatctcctccgaccccggcacgcacccggagccggtggccgaggcgggcgtggacgtgtacgcgtacacgcacaacgagacctcgacgggtgtggccgcgccgatcaagcgcgtcgcgggcgccgacgccggttccctcgttctggtggacgcgacctcgggtgccggcggtctgccggtggacatcaccgagacggacgtctactacttcgccccgcagaagtccttcgcctcggacggcggcctgtggctggccgcgttctccccggccgccctggagcgtgccgcccgcgtgcacgcctccggcagccggcacatcccggagttcttctcgctgccgacggcgatcgacaactcgctgaagaaccagacgtacaacaccccggcgctgtccaccctcttcctgctggaccagcagctgcggtggatgaacagccagggcggtctggagttcaccaccggccgtacggcggccagtgcgcgcaacctgtacggctgggcggaggcgtcgaagtacgcgaccccgttcgtcgtcgacgccgacaagcgctcctccgtcatcggcacgatcgacttctcggacgacatcgacgcggcggccgtcgccaaggtgctgcgcgccaacgggatcgtggacaccgagccgtaccgcaagctcggccgcaaccagctgcgcatcgcgatgttcccggcgatcgacccggcggacgtgcaggcgctgacggcctgcatcgaccacgtgatcgagaagctctgaccaccacccgcccggtacgacgcgaagcccccggtgacctgcggtcgccgggggcttcggcgatccccggacaccccgaaggccaccggcgtgcggttctcccgtacgcggtaccttcagggctccggcggcgattcttggaggcagcggcgtgagcgtgcgagtgacggcggcccagagcggtgtggaccccttcggcacggcccggctgcggcgcggggtgctcgacgcgtggggtgcgggcccggcccggttccgcgaggacgccaacgccgaggaggacctcgcgctgggcggctaccgggaccggctcgtcgtcgagctggcgcagaacgcggccgacgccgcggcccgggccaaggtgccgggccggctgcggctcaccctgcacgagggcgagggcgggcacgccctgctggccgtcgccaacaccggtgccccgctggacgcgacgggcgtggagtcgctgagcaccctgcgcgcctccgccaagcgcgagccctccggggacagcgtcggccggttcggtgtcggcttcgcggccgtgctggccgtctccgacgaacccgcggtgctcggccgccacggcggtgtgcgctggtccctggccgaggcgcgcgagctggcccggggcgcggccgtcggcagccccggcctcggcgacgaactgcgccgccgcgacgggcacgttccgctgctgcgcctgccgctgccggccgagggcaccgcgcccgagggctacgacaccgtcgtggtcctcccgctgcgcgacgccgccgccgaggggctggtggagcggctgctggcgggcgtcgacgacgccctgctgctcaccctgcccgggctgtgcgaggtcgtcgtggagaccccgtccgagggaacgcgcaccctgtaccggcgcgacgagggcccgtacacggtcatcgaggacaccaccgcctccggcacggtcacccaccgctggcgcaccgtccgccacaacggccccatcgagcgcgcgctgctcgccgaccggcccgtcgaggagcggctgcggcccgcctgggcggtgtcgtgggcggtgcccgtcgactccgaaggcgccccggtgcgcccggtcacggcccccgtggtgcacgcgccgacgcccaccgacgagccgctgggcatcccggcgctgctcatcgcgaccctgccgctcgacaccacccgccggcaccccgcgcccgggcccctgctcgacttcctcgtggagcgcgcggccgacgcgtacgccgaactcctcggcgcctgggacccggtgaccaccgccctcgtggacctggtgcccggcccgctcggcaagggcgagctcgacggggccctgcgcgccgccgtcctccagcgcctgccccgtaccgccttcctcgcaccggccgcgccgcccgagcacgccgaggagcggggcgccctgcgccccttcgaggccgaggtggtggagggcgcgggcgccgacaccgtacgcgtcctcgccgaggtcctgccgaccctgctgccggcgggcctggagcgccgggccgaactgcgcaccctgggcgtgggccggctcccgctgggcgacgccatcgagcggatcgcgggcatcgagcggacccccgagtggtggcaccggctctacgacagcctcgccggggtggaccccgaccggctgtccgggctgcccgtgccgctcgccgacggccgcacctcgatcgggccccggcacatcctgctgcccggcgcggacacgccggcgagtctggcccggctgggcctgaaggtggctcacccggacgcggcgcacccgctgctggaaaagctgggcgcgctcccggccacggcccgggcggtcctgacgaccccgcaggtgcgggcggccgtcgccgcttccctcgacgccggggagatctgggacgaggacggcgacaccctggacgccgacgagctggccgaggtggtcctggggctggtccgggacgccgatctggcgccgggcgacgagccctggctcggggcgctggccctcccggacgaggacggcgaactggtcccggcgggcgagctcctgctgccgggcagcccgctggcctcggtgatccgcgaggacgaggtcccgtacgtggacgcggacctcgccgagcggtggggcgcgggcccgctcaccgcgtgcggagtcctggccaccttccagctggtccgcgccaccgacgtggtcctcgacccggacgagctggaaccgcgcgagggcgacttcgcggagcccgacgacgcgggcctgctggacgcggtggacgtgtggtgcgaggacgtcctggaccagctgccggagctgccggtaccgccggtggcgaccgagctgatcgccgtccgggacctcgacctggtcgacgacgactgctggccgcaggcgctcgccatgctcgcgcagccgccgctgcgcgacgcgctgacccagcccgtgcggatcctgctgccggacggcaccacgcagtcggtgcgcccgtacaccgcctggtggctgcgcgaccacccggtgttcgacggccgccgcccggcgggcctgcgcgcggcgggcggcgacccgctgctggacggcctctacacctcggcggacgccacgggcttcgaggacgagcaggtcctgcgggcgctcggcgtacggacgacggtggcggccctgctggacgagcccggcggcgccgccgaactgctggcccggctcgccgacccggaccgcgaggtcaccggccatcagctgcacggcctgtacggcgcgctggccgatctggaccccgagcaggtcacgctcccggacgagctgcgcgcggtggtggacggcgaggtgctcgtggtggacgcggccgacgcggtgatcgcggacgccccggacctgctcccgctgacggcggggctgccgctgctgccggtgcccccgtcgcgcgcggcggatctcgcggagctgctccaggtccggcgcctctcggagacggttccggcggaggtgaccacgcccggcgagacgcacgaggttccggagtcggtgctcgtcctgctgggtccggccactcccgcgacgtacgtcgagcacgaggagctggtcgccggcggcacggagctcgactggcgccgcacccccgacggcacgctccacgcggccacgctggagggcgtggcggccgggcttgcctggtcggcgggccagtggccgcgccgcttcgaggtggcggcgctgctggaggacccgtcgcgcacggcggaactggcccgggaccgctggttcgactgacctgcgcggggcagggccgcggggcgggaggaggccgcgcggccgcccggaagctgtgggttccctttgacaggcggcacctgccgactcagactgatcgttgctttcgtccgaccggcggagccacgaccacgtagagaacgcgccctcagggaatcgttcagggggagcgtcatgtccgacaggagagcccgttcggcagccttccgctggtcccgcgggccggtgtccgagctgttctccggacggaacaacagcctgggcctcctgcggctgctcctcgcgtcggccgtcgtggtctcgcacgcgagcgtcctcggcttcgggcgccatgagttcggtcacagcttctcgcagggtcagatcgacctcgggaagatggccgtcttcggcttcttcttcctctccggcatcctcgtgacgcgcagcggcaaccggctgcccgtcggccgtttcctgtggcatcgcgcgctgcgcctgctgcccggcttctgggtctgcatggccgtcacggccttcgccgtggcgcccttcctgtactggcgccagcacggcagcacggcagggttctgggaccacccgcaggggcccttctcctacgtcgaggcgaactgggccgtcggtatcggccagtggggcatatccgacgtgctggagaccgcctccgccaaggggctcacccacaacgtggggatgaacggggccctgtggtcgctggcgtacgagatcctctgctacttcggcgtcgccctgctggcgctcggcggctcgctcgtccgctcccggcggaccatcctggcggtggcggtgatcctgggcggcctggtcttcggcgatgcgatcggcaaccggctgatcagcggggccggggcggcggcgcacggcgggaacgtgatcgtcccgctgatgggcccgcagagcctgaacaccatcatctacctcgggttcgccttcgccctcggtgcggtgctggaggtctacaaggagcgcgtcccggtcagcgacccgctggcgggcctcagcgccgtggtgttcctgctgaccctgcactacgggtacttcttcgccctgggcgtgccggccttctgctacctgctgctgtggctggccatccggctgcccaagccgttccagcggatcggcgccaagcacgactactcgtacggcatctacatctacggcttcctcgtccagcagtcactggccgtcctcggcggcgcgcgctggggcttccccgcctacctggggctctccctgggcggcgcgctggtcgcggcggtcctctcctggcacctggtcgaacggcaggcgatgcgcctgaaggacctcggcgccccgcgccgcccggcgtccggcatccccgctccccgcagcggcgccccggccgagggacagcggcccgtaccggttgcctgacccggtcaggccgggaacttccggtcgacccacctgaaggtgaactcgatcaggacggcggcgcccacggcgacggccaccgcgatccacggcaccaccgcgcccaccagcttgagctggaagaagtcctgcagccacggcacgacgaggacgatcaggaacgccccgcccatcgcgccgaccagggccatccgccaccacgtgtacgggcgggcgatgatcgccaggacccacatggacgtcaggaacagggtcagcgtggccgcgctggactcggcttcgagcgcaccctggccggtgtagtggtggcgggcgatcaggtacgagacgaaggtggccacggccgcgatgacgccgccggggatcgcgtagcgcatgacccgcttcacgaagtgcggtttcgcgcgctccttgttcggggccagggccaggaagaaggctgggatgccgatggtgagcgtggacagcagcgtcaggtggcggggcaggaaggggtactcgacctgcgagcagaccaccaggatggccagcagcaccgagtagaccgtcttcgtgaggaagagggtcgccacgcgggtgatgttgccgatgacccggcggccctcggcgaccaccgagggcagcgtcgagaagctgttgttgagcaggacgatctgggccaccgccttcgtcgcctccgagcccgagcccatgctgacgccgatgtccgcgtccttgagggccaggacgtcgttgacgccgtcgcccgtcatggcgaccgtgtggcccttggactggagggctccgaccatgtcgcgtttctgctgcgggctcacccgtccgaagacggagttgtcgtcgaggacctgcgccatgtcgccctggtcggtggggagcccgcgggcgtccacggtgttctccgcacccggcagccccagcttgccggcgaccgcgccgaccgagaccgcgttgtcgccggagatgaccttcgccttgacgtcctggtcctcgaagtagcgcagggtgtcggcggcgtcggggcgcagccgctgttccaggacgaccagggcggtcggccggaccccggtggcgacggccgcgtcgtcgagttcgcgggcggaacgggccagcagcaggacccgtagtccccgctcgttgaggtcgttgatctcgtccagggcggggtccccggcgggcagcagtacgtcgggggcgccgagcagccaggtgttgttctcgccgtcgccctcgctgaagctggcgccgctgtacttgcgggtggaggagaagggcagggactcggtgcagcgccactccgccatgtccggataggcgtcgatgatcgcctggaggctggcgttggggcgcgggtcggactcgccgagggcgccgagcaccttcttgacgtacgccggctcggcgccgccgagggggcggagctcggtgacgtccatgccgccctcggtgagggttccggtcttgtcgaggcagactacgtcgacgcgggcgaggccctcgatggcgggcagctcctgtaccaggcactgcttgcggccgagccggatgacgccgatcgcgaaggccacggaggtgagcaggacgagtccttcggggatcatcgggacgatgccgccgacggtccgggcgatggagtccttgaggttgttgtccttgacgaggagctggctgatgatcaggccgatggaggtcgggatcatcatccaggtgacgtatttgaggatggtggagatgccggagcgcagctcggagtggacgagcgtgaaacgggatgcctcttcggccaactgggcggcgtaggcctcgcggccgaccttggtggcggtgaaggcgccgccgccggcgaccacgaaggaaccggacatgacccggtcgccgggcttcttcaggacggggtcggcctcgccggtgagcagggattcgtcgatctccaggccgtcggcctcgccgacggatccgtcgacgacgaccttgtcgccggggccgagctcgatgacgtcgccgaggacgatctcggaggtggagatctcggcggtccggccgtcgcggcgcacgctgggtttggcctcgccgatgacggcgaggctgtcgagggtcttcttggcgcgcagttcctggatgatgccgatgccggtgttcgcgacgatcacgaagccgaagaggctgtcctggatcggcgcgacgaagagcatgatcacccagaggacgccgatgatcgcgttgaaccgggtgaagacgttggcgcggacgatgtcggtggtggagcggctgctgcggacgggaacgtcgttgacctcgccccgtgcgacgcgctcggcgacctcggccgtgctcaggccgcccggcttgaagaggggcgcgggcgggcgaaccgggtgtacggggtccagctcggctcccgcgtcgatggcgggggcggccgtcccgccgcccggctccggcccgtcggattcggttccagcccgctgcgtcatgccttcgacgttaaacggggtgcgaactgttcacccgccgagcaggaggaagatccgacctcaggatgacccgaatcgtcccctggtagcgccgcggatcgccccaccccgaagccgccggacccgcacccgcgccgccgctagtcctgcgggccgggctccggctccggcggagcctgggccgcctgttccacctgttccgccgcgtggcgggcaagcgccgcgtcgcggccgcggacgtaccagatgccgatcaggccgaggaagccgccggccgcgcaggtccagacccaccagaggcggccctggtcggcgaaccacccgtagaagggcagctggaccaggaagagggcgaaccacaggatcgtgccaccggtgacggtggcgacgaccgggccctccaggggctcgggcgcctcgtgcttcgcagtccatttcgccatgcggcaagtctaggcggcgcgaaacgacatctacgcgcggagatggacgcactttcgttcatgtgttcatactgaaacggtttgggcgcggcccattttcttcgtatgaaccacccaatgaggaccgtatgagcactccggcccccgcccccgcagcgaccgccccggagccttccccccaggaaccctccggcccgctggaccgctacttcaagatctccgagcgcggctcgaccctcgcccgtgaggtccgcggcggcttcgcgaccttcttcgccatggcctacatcatcgtgctgaacccgatcatcctgggcagcgcgaaggacatgtacgggcaccagctcgacaacggccagctcgtgacggccaccgccctgacggcggccttcaccaccctcctcatgggtgtcatcggcaacgtcccgatcgcgctcgctgccggcctcggcgtgaacacggtcgtcgcgctccagctcgccccccgcatgagctggcccgacgccatgggcatggtggtcctggccggcatcgtggtgatgctgctggtcgccaccggcctgcgcgagcgggtcatgagcgccgtcccgctgggcctgcgcaagggcatcgccatcggcatcggcctgttcatcatgctgatcggcctggtcgacgcgggcttcgtctcgcgcatcccggacgccgcgcacaccacggtcccgctccagctcggcagcgacggccacctgcacggctggcccgtcctgatcttcgtggtcggtgtgctgctcaccctcgccctgctgatccgcaagacgccgggcgcgatcctgatctccatcgtggccatgaccgtcgtcgccgtcgtggtccagctgatcgtccagctgcccgactccggctggggcctgaccgttcccgaatggcccggcaacccggtggccgcgcccgatttcgggctcgtcggccaggtcagcctgttcggcggcttcggcaaggtcgggatgctcaccggcatcctcttcgtcttcaccgtgctgctgtcctgcttcttcgacgccatgggcacgatcctcggcgtcggtgacgaggcgaagctgatcgacaagaagaccggcgagttccccgggatcaaccgggtcctgctcgtcgacggcctggcggtcgcctcgggcggcgccacctcctcctccgcgaccacctgcttcgtggagtccacggccggcgtcggcgagggcgcccgtacgggcatggcgaacgtcgtgacgggcggcctcttcgccgtggcgctgttcctcgccccgctcgccaccatggtcccgtcccaggcggccaccccggcgctcgtggcggtgggcttcctgatcctggcgggctcggtcagggacatcgactggagcgacttcaccatcgccgtcccggccttcctggccatggtgatgatgcccttcacctactcgatcaccaacggcatcggcatcggcttcatcagcttctgcgtcctgcgcctggcgaccggccggggccgcggggtcccggtggccatgtacgtggtgtcggcggtgttcgtcttctactacgcgatgcccgccctcggcctcgcgcactaggtcgaggagacgacccggctcacgtcagcccgtagaacttctctgtctcgtcgacggccgccttgaagcgctcgtcgaagtcatcgcgaatgagcgtccggaccacatagtcctggacgctcattccgcgtttggccgcatggatccggagcctgtcgaggagctccccgtctatgcgcatgctcagcacatgtgtccccatgccgaaagagtcggggcacggggtgcgcacgcgtgtcactttcagccgccgactcacccgtatgagtgaccccaggtgtgagccggaaaactggtgttccttagcgagagtaatgagttactctaaatacatgcatgacctctcccatggcgacgacgcagccgccgtgaacgacctccgctccgccgtcatgcggctggggcgacgcctgaagcaccagcgcgtcgacgagtcgctgagcccgaccgagatgtcggtcctcggcaccctcgcccgctgcggccaggccacacccggcgaactcgcccggcgggagcacgtccagccgccgtcgatgacacgcatcgtcgcgttgctggaagccaagggactggtcacgctggaaccgcaccccgacgaccgccgccaaaaggtggtccgccagacggaggaagccgaagcgatgctcgaagagagccgccgcaagcgcaacgccttcctggccgggctcgcagccgagctgaccgaggacgaatgggccaagctccgcgcggccgcacccgtcctggagaagctcgcgcacctctgaggaacgacgccaggaggcgaacgcttttgagtacgggaaccggagcagactccgcacccggccacacatccacccccgctaccgccgcgaccctcgcggcacccgcgagcaagggctccatgttcggctcgctgaagatccgcaactaccggctcttcgccaccggccaggtcgtctccaacacgggcacctggatgcagcgcatcgcccaggactggctggtcctctcactgaccggctccgcctccgccgtcggcatcaccatcgccctgcagttcctgccgatgctgatgttcggcctctacggcggcgtactcgccgaccggctgcccaagcggccactgctcctcgccacccagagcgcgatgggcctgaccggcatcgccctcgccgtcctcaccctggccggacacgtccaggtgtggcacgtctacctcgccgccttcgccatcggcctggtcaccgtcgtcgacaacccggcccggcagaccttcgtccccgagatggtcggcaaggaccaggtggccaacgccgtcagcctgaactcggccaacttccagtccgcgcggctggtcggcccggcgatcgccggtgtgctgatcaccgccgtcggctccggctgggccttcctgctgaacggactgtccttcgccgcgcccatcgccggcctgctgctgatgcgcacgcacgaactgcacccggtcgagccgaggccccgcgccaagggacagctgcgcgaaggcctgcgctacgtcgccggccgcccggagctgatctggccgatcgtgctcgtcggcttcatcggcaccttcgggttcaatttcccgatctggctctcggcctacgtcagcgacgtcttccacggcgacgcgggcacctacggactcttcaacaccctgatcgcggccggttccctggccggcgccctgctcgcggcccggcgcggacagtcccgcctgcgggtcctggtcgccgcggccgtactgttctcggtcctgctcctggtgaccgccttcgcccccggcttctggctgttcgccgccctgctcgtacccatcgggatcttcggcctgacggtcaacgtcacggccaactccagcgtgcagatggcgaccgaccccgagatgcggggccgcgtcatggccctgttcatgatggtgttcacgggcggcaccccgctgggcgccccgctgctgggctggatcaccgacacctacggagcccggatcggcatggcctcgggcgccgtgatctccctggccgcctccgtcgcgatcgcggtggtcctggcccgggtcggcaacctccgcatgcggctgagccgccgcggcgtggccttcgtcccggccgccccgccccgccgcgaactggtgacggtggcctgagccggagccgacctgccggggctccgcgccatccagccccgccggccgttgcggcgccgctgtcgggcgcggagcccccgacagcggcgccgcgcacggctacgctcaccggcatgagactgttcgcagccgtcctcccgccggaggcggccgtcgccgagctcgccgccgccgtgcaggcggtccacgacgaccggctgacctggaccggacgggccggctggcacttcaccctcgccttcatgggcgaggtacgggaggaggtgctcccggaactgcacacccgcctggagcgggccgcccaccgcacggcccccttcgcactgcggctgcacggcagcggccacttcggggagcgcgccctgtgggtcggcgccgccggcgagctcgccgccctgcggatgctcgccgaccgggccgacgccgccgcccggcgggccggcgtaccgatggagcagcaccaccggtacaccccgcacctcaccctggcccgcagccgcggcgccaccaccccgctgcggccctacctggacgccctcgcccccttcgagggcacgtcctggcaggtcgccaccctcagcctggtccgcagcaacctccccgtcagcggggtgccgggcgagcagccccgctacgagaccgtcggagcctggccgctgcgcggctgaacccgcacgccccccggttcgggccggggggcgtgcgggagagccggcgggccgcgttaggctcgacgggtggatcccaagaccagaaaccgcgtcatggccggtgtgctcgtactgatgttcgtcgtcgtggccgtggcggctgccgtcggccagtagcccctcgccccgggccccggcctaccaggcgaaggcctccggcgatgcccccggaccggggaagatctcttccaggcccgccaggacctcgtccgagagctccagctccaccgcgcgcagcgccgagtcgagctgctcctgcgtacgcggcccgacgatcggcccagtgaccccgggacgcgtcagcagccaggccagaccgacttcgcccggctccaggccgtgcttgtccagcaggtcctcgtacgcctgcacctgggcccgtaccgtgctgttggccagcgcgtccgccgaccggccggaggcgcggcggccgccctggacctccttcttgatgaccccgcccagcaggcccccgtgcagcggggaccacgggatgaccccgagcccgtacgcctcggcggccgggatgacctccatctcggcgtgccgctccgcgaggttgtagaggcactgctcactgaccagtccgagccgtccctggcgggcggcggtctcgttggcctgggcgatcttccagccggggaagttggaggagcccgcgtagaggatcttgccctgctggaccaggacctcgacggcctgccagatctcctcgaagggggtcagccggtcgacgtggtggaactggtagacgtcgatgtagtcggtctggagccgcttgaggctggcgtcgacggcgcgccggatgttcagcgccgacaggcggccgtagttgggccaggtctcgccctcgcgggacatcgaggcgtagaccttggtggcgaggaccgtcttctcgcggcggtcgccgccctgggcgaaccaggtgccgatgatctcctcggtgcggcccttgttctcgccccacccgtacacattggcggtgtcgaagtagttgatgcccgcgtcgagggcggagtccatgatcgagtgactttcgggctccccggtctgggggccgaagttcatggtgccgagaacgagtcggctgaccttgaggccggtgcgtccgagctgcgtgtacttcatgggccactagccaactgcttcgagtgcgctcgaagcaagaccccgccgtgaagggcgtgttacggctcccccgcgcggcggtaggggccgccgatgccccacgcctggtgcaggacggccgcgaactccccggccagccggtgctcgcccgaggcgttggggtgggtgccgtcgtaggtgtcgcggtggatgtcgtacgcgtccgggcgcgcggccagcaggatcggcgaggcgtcggtggtcaggtcggccacggccttcgcgaggagctcgttgaaacgggccacctcggccgcgaagggggcgtcctcctcggcccggctgttcgggatgaccggcagcaggatcatgcggacggcggggcgggccgcgcgggccccggcgatgaaccggcgggcgttggcggcggtctgctcggcgtcggtgtagaagccgaggtcgatcagcccgagggagaccagcaggacgtcggccccggtcgagtcgaccgcgggaccgatgaggggggccatgtgctgccagccctcgccccagccggccagatggcggcgggcgcgctccggaaagcccgggtcggcgtaggcgtggctggtgggcgtgtcggcggcggtgtcgtacagctcgcagcgcggaccgacgatccggtagggaccgccgaaggtcgagctgaggtgctgccacatccggtagcgccaggtgtagtcgccggcgcgtccgatggtcatggagtcgccgacgaacatgaaacgcatccggtcatcatcgcggatcgcgcgacagaaacccctgtgacgccggacacgcggcacgtactggcaggctgggggaatgcgcctgtccaagccgtccgccgccgcgtccgccgccgttgccgtcaccaccgccgtcgccgccgccgcactcgccgtgccgccggtcccggccctcgcggcggggtcccccgccacgtcctccttcaccatctccgacccgcggatcaaggagtcgagcggcctggccgccagccggatccacccgggcgtgtactggacgcacaacgacagcgacgacggcccgtacatctacgcggtggactcggcgacgggccggacggtggcccgcgtgacgctgaaggggatcggcacgccgcgcgacgtcgaggcgatctcgctcggcccggacgggcagctctacgtcggggacatcggcgacaaccgcaacggcacctgggaccacgtgtggatctaccgcttcccggaaccgaggcaactgggtgatgtcacggtcgaggccgcgcagttcacggtgaagtacgcggacggtgcgcgcaacgcggaggccctgatggtccatccggtgacgggccgcgtctacatcgcgagcaaggacgagaacaagggcggcctgtacgagggtcccgcggagctgacgacgggcggcacgaacgtgttccggcgggtcgccgccgtgccgtgggtgacggacggggcgttctcgcccgacggcacccggctgacgctgcggggctacttcacggcccgcacctacccgtggaaggacggcctgccggtcggcgagggcgagcgggtggacgcgccgtggcaggggcaggcggagtcggtgacgtacacgccggacggctcgacgctgatgttcggcgcggagggcgagggcagccgcgtcatcgccgtcccggtcaccgccgccccctcggccgggtcctcggcctctccgaagccgggctccccggcgggcgcgtcccccgcgacgcagccgacgggcagcttcggcaagggcgccctcgtcctggtgggcggcctgatcctggtcttcggcaccaagcgcctcctgcgacgccgccgcacctgaccggcgccgcatcatcccggcctcgccggcgtttgaggcgcgggggtccgggggcagcggagccgcacccggggctccgccccggaccccgctcctcaaacgccggaggggctgaattgacgggttactcctcgcggatcgggatgcggccgttcaccggtggggcggccggggacggagttcccggggcggggggctggcccatcgaggccaggagctggcgggccacgcccaggccggtgccgcccatcgtgagcgccttcgcgaacatctccgacatgccctcggccccgttcagcaggaccatgtgctccacgttcccgaaggccccggcgcccgcctccacgatcgccggccagttctcggccagctgctgcgcgaccaccgcctcctggttctcggccagcgcggcggcccgcgccttgatcgcttccgcctcggccaggcccttggccttcgccgactccgcctccgcgaggccccgcgcctgggtggccgcggcctcggcctcaccggtcgcccgcgtggccttcgcggacgcgatgccccgcgcctccacggcctgcgcgtcggcggtcgccgccgtcgtcacccgcgtcgcctcggcggccgccgcgagctccgtctcccgcgccttcgcctgcgccgccgagatccgcgcgtcgcgctcggcctccgcccgcgtgcgggtctcgtacgccgccgcgtccgcgggcttgcgtacgtccgcctgcagctgctgctcgcgccggtgcgcctccagctccgccacccgggtctcctggacgacgacctcctggcgggcggccgcctccgacagcgggcccgcctgacgggccgtcgccgccgccttgtcgcgctccgcctggtatccggcctgcaggatctcgctgtcgcgcgtcgcctcggccatccgggcgaaggcggcctgctcggcctccgtggccagccggttcgcctcggcctgcgcgatccgcgcgtcccgctgcacggccgccgcgtgcggcatcgccaggttcttgatgtagccggtcgggtcctcgatctcgtggatctgcagcgagtcgacgatcaggccgagcttctccatctcggtaccgcacgccatccgggtctgtcccgtcagcttctcccggtcccggatcatgtcctcgaccgtcagaccgcccacgatggagcgcagatggcccgcgaagacgatgtgcacgcgctcgggcatcatcttctgctggtccaggaaacggcgggccgcgttcgcgatcgacaccaggtcgtcgccgaccttgaagatgacgacgcccttcacccgcagcgggatgccctggtgggtgacgcagtccacggacagctgggtctcgttgaggtccagggacagcttgcgcacggcctgcacgcccggaagtacgagcgtcccccgaccggtgacgatccggaaccccatgccctgcccgaggccctcggtcttgtgcgtggagccggagatgacgagtgcctcgttcggttcggccacccgccacatgagcttgaacaggccgatcagagccacgattgcggcgagaacgattcccgccacgacgccgatagccatcggcaacgcccccttagcgcggtgccgttcggcaccgacgaggccgagtctgcgcctgccgcggcccggctggaagatgcgggccgcgtcttgtcgccatcttgatacgtacaggtgggacggggcgtcagttgtcgtaggcggccatcacgtacaccgtgcgcggcggcaggtgctcgacgaccgtcaccaccgtcccgacggcgagccggcccgtcccggcgaccgggtgcgcgaggaagtgttccgccccgccccggatccggacgatgacctcgcccaccagccccggcccgaccgtcccggtcacccggccggtcatgcccaccatgtccgtgtccgtgtccgcgcccctgtcccccatgggtcgagggtacgccgggcgcgagcgccctacgagcgccctacgagtggccgaggtccgcggccggcaggtccgactccgagaccgggacggagccggtgtcgggggcgggtcgcagggtgaactcgtccgaggccatcgagtcgagcaccggcggcgcgggccgcagcggcgccggcatgaccgcggcctcggagtggccgccgcagccgtaggacagcgagaccaggcggccgtcggcggggctgaactcgttggcgcagacgccgaaggcctggccgagcgagccgccgatggcgacgaggaagccgcaggagacgcaggacgcgggcgcggcctgcgccatcggggtcttggcgccgaaggactcgtcccagcggtcggcggcggtgtgcagcccgtaccgcgacagcacgcgtgcccggcgcatgccgagttcctcggcgaccgaggtgatggagccgcgtacggggaccaccgcgcggtcggtgacgtcggcgtcctcggcctcgaccagttcggccatctcggtggagaccacggagttcggcggcggggtgtcctcgcccgaccagcccggctccaggcgcaggtcctcggcgtcggtgggcagcaggtcgccggggcccatgtcgccggggcgcagccgctcgctccacggcacccactcgggggccagcagggcgtcgtcgcccggaagcagcaccgtttcgtcgagggtgacgttcttcgcgcgggaggcgcgggtcacggtgacggcccagcgccagccgcggtagccgggctccttggactcgaagaagtgggtgacgacgcggtcgccctccgccacggcggagacgtgcgcgcccaccactccggggaaggcggcctcctcggccgccgcgcgggcgagttctaccgcctcgacgcacaggcggtcgggggtacgcggggtacggcttcgcgtcgtcgcagcactcactggtctcgttctctcctacgccgtctcacgtgtgcgccgtccgtactgtcgtccacaacgacccgtcggtgctgtccgtacgtggcacgggcggagcggaccagagggccgcgtcgacgtccgcacccgatcggactccgggcgcacctcactgcaacccattctgcgggatcacgaagaggcgcgcggccaggagcaaccgccggtggcgcgctacgcacgctacctcgtcttacgccccgggcacacatgcaaggtccgattcgcggacaagccaccgggtgcgcgacgcgccgagaggcgcccggacggggccgggtggggcactatgtcgagtgtggcacccgtacggtcgtccgacgacggctcgggaccggccaggcgggccggccgggctgtcgggcgtgcgctgcaccttccggcgcgcgggatccggcgggccacgcacgcgcacggggccggggaatcgggcctcggcaagctgatcgagctgcacgccatcaacggcgccggtgacgtgatgatcacggtggcgctggcctcgacggtgttcttctccgttcccacggacgaggcgcgcggccgggtggccctgtacctggcgatcacgatggcccccttcaccgtgctggccccggtgatcggtccgctcctggaccggctgccgcacggccggcgggcggccatggcggcctcgatgctggcccgcgcgctgctggcgctgctgatgtcgggcgcggtggcgacggggggcattcagctgtatccggcggcgctgggcgtgctggtggcgtccaaggcgtacggggtggtccgcagcgcggtggtgccccggctgctgccgccgaaattctcactcgtgaaggcgaactcccgggtcacgctggccggtctgctggccacgggcgcggcggcgccggtgggtgccgccctgcacctgatcgggcctccgtggccgctgtacggggcctgcgtgatcttcgtgtggggcacggtcgcggcgttcacgctgccgcacaaggtggacgaggccaagggcgagcgccgggcgcggctgtccacgcacgaggcgcattcgaagcggccgggcctgcggacggtcagccgggcggtgctgtgcgggctgctggcgaacgcctcgatgcgtgcgctgtccgggttcctgatcttcttcctggcgttcctgttgcgcgagcatcccctggcggggcagagcgcggcggtgtcgctgggcatcgtcggcgtgtcggcgggcgtgggcaacgcctgcgggacggcggcgggcgcgtggctgcgggcgcgggcgccggaggtcatcatcgcgtcggtactgagcctgaccctggcggtggcggttctggcggcggtgttcttcagcgggctgttcatggccgtgctgggcgcgacggcgggcttctgccaggcgctggcgaagctgtcgctggacgcgatgatccagcgggacgtgccggaggcggtgcggacctcggccttcgcccgttcggagacgctgctccaggtggcctgggtgctgggcggcgcgatcgggatcgtgctgccgctgaacggcgtactggggatgtcggtggccgcggcgatcgtggccatgggcacgacgatggcctaccggggtgtcctctcggccccgcgcccgcaccaccggggcacctcccgcccccgcgtggcgtagccccttgcccggcgggggcttcgggcaaccggagcaacgccgcgccgcaggccaccggtaccccatgcagcggcgcagcgcaggggcccgatagccttcggctcatgaccgcaccgcttttctcgggtagggcccgccgcagcgtcgcggccctcggagccgtgtccgccggcttcctcctcctttccgcctgtggcgagaagccgacgccgctggcgaccgtgacggtcggcacctcgtcggtgtccgccgaagcgtcctgccacggcggcaaggagccgctctccatggaacgcgtccaggagtgcctcaccaacctcaaggaccccaagaccatcgagtacgcccggggtgacaccctgcgtctcggtgtcgagccggaggtcgtcgaggacggcaagcgctggtcggcggtgctggacggccagccgatcaccgagccctcctcgaacacctaccgcagcttcccgggcgccgacgtcttcgcgaccggtggccagggcgaggccccctcctcgaagaagctggcgttcctgcagatcgcggaggacggccagccgctcgccgtctggtccttcaacctcaagctcaagtaaccgggcggcagcggtgcgcgcgctcgtcgtgaccgcggtggcggcggaggcagactccgtcaccaccgggctgacccctcatccggacactcctggtcctgagccacgcaccttgcccggcggttacctcatccaccgccgggaccttccgggcatcgccttcgacgtgctcgtcgggggcgtcggcccggcggcggccgccgccgggaccgccaccgccctggccctcgccgactactcgctcgtcgtctccgccggcatcggcggcgggttcgtgcccgccgccccgctcggctccctcgtggtcgccgacgcgatcgtcgccgccgacctgggggccgagacccccggcggcttcctcgacgtgacggagctgggcttcggacacagcgtgcacctgccgcccgccgagctcgccgcccgcgccgccgaggcgaccggggcgctgctcgcgcccgtgctgaccgtttccaccgtgaccgggaccgcctcccgggccgccgggctcgccgcccggcacccgatggccggggccgaggccatggagggtttcggggtcgcggaggcggccgcgcgccgtgtccaacgccgtgggccctcgtgaccgtgccgcctggcggatcggggacgcgctcaccgcgctcgccgacggcttccgcgtgctggggcccgtactcgcgaactggggagaacgccatgagcacgaccaccggtgaaccgctgaagatcgcctattcgccctgcccgaacgacacgttcgtcttcgacgcgtgggcgcacggccgggtaccgggcgcgcccgccctcgacgtcaccttcgcggacatcgacatcaccaacggcatggccgagcgcggcgagctggacgtgctgaaggtgtcgtacgcggtgctgccgtgggtgctggaggagtacgcgctgctgccgtgcggcggggcgctggggcgcggttgcggcccgctggtgctgacccgcgagccgggcctggacctggcggggaagacggtcgccgtgccgagcgaacgctccaccgcctacctgctgttccggctgtgggcggcggacgtgctgccggagggcgtcggcaaggtcgtcgtcctgccgttccacgagatcatgccggcggtccgggacggccgggtggacgccggtctggtgatccacgaggcccggttcacctatcaggactacgggctgcactgcctggccgacatgggtgagcactgggagtccacgaccggcctgccgatcccgctcggcgcgatcatcgcccggcgctcgctgggcggtgaacggctgcgcgcgctggccgagtcggcccgtacgtcggtccggatggcctgggacgacccggaggcctcccgcccgtacgtccgcgcgcacgcccaggagctggacccggccgtcgccgaccagcacatcggtctctacgtcaacgagttcaccgccgacctcggcgactccggctacgcggcggtgcgcggcctgctcacccgggcggccgccgagggactggtaccggccatcgcgcccggcgcgctggagttcccgcggggctgagccgccccgtacgcacgaccgcgccccgccactctttcgagtggcggggcgcggtcgtgcgcgtgccggtgaggctcagacgtcgagctggtcggccaccgcgcgcagcagtccggcgatcttcgtgccgtgcaccttgtcggggtagcggccgcgctccagcatcggggtgatgttctccagcagggtcgtgaggtcctgcacgatcgaggcgagctcgtcgggcttgcgccgctgcgccgccgcgacggagggtgccgggtccagtaccgtcaccgaaagtgcctggtcaccgcgctgacccgcgacgacaccgaactcgacgcgctggccgggcttgagagcgtccaccccggcggggagcaccgacgagtggacgaagacgtcgccgccgtcgtcgcgggagagaaagccgaagcccttctcactgttgaaccacttgaccttgccggtaggcacgtccgtcctctgtccttgtgctcgtcggggtccgaagtgccgctgaacggctccggacaacagcgcagcgggccatgtgtgacccgccatctcaaggctaatggtcaggggccgggtgacaagacgttccccggtccttcgccgtcggctgccttcggccaggcaactaccctggtgaggtgactgttactcctcattccgacgaagcgcggcccggcgacggactcgtcaaggccggcggcatcgtgttcatcgccggggccgtcgccacgctggcgaccatggctccgctcttcctcgacgtcgacccgttcccgtcgtacgcgtgggcggtgtgcatgctcatgggcgtcggcttcgccatctccgcggcgggcgtgctccgctcggcggcggcgcagcgcagggcggcccgggcctcacaggcgtagccgcccgggcacctccccgggccctgcccctaggccggctgcgcggcgacgtactgcgcgagccactgcggcagcgcggtgaggtcgggcagcaccacgtccgcgcccgcctccagcagttcctcctccgggcacgggccggtcggcaccaccacggacagcgcgcctgccgtacgggccccgcgtacgtcgccgacgtggtcgccgacgtagacctgcgccccgtgctcgcgcagcgcaccggccttggcctccgcccacagccagccgatgaccgcgtcggcctcgatcccgaggtgcgacaggtgcagccgggcgttgggctcgtgcttggcggtgacgacgatcgcgcggccgcccagcgcccggacggcctcgacggcctcgcgggcgcccggcatggccggggtcggcccgatggcgtaggtggggtagatctcccggtagcggtcggccatggccgggatctcggcctccgggaaccagtgcgcgagctcctcctccagaggcggccccagccgggtgacggcctcgtcggcgtcgatgaaggtgcccgtctcggccgacagggcctggtaggcggccctgatacccggacgcgagtcgatgagggtcatgtcgaggtcgaagccgacggtgaggttcatgccgtccattgtgccgacgcggccgcacgggaggccgaccgcgggccgaccgcgggccaccatcaggagaacgcctcgtgctcggcgggttcccggctccttcgaaatccttcacatcggtgttcaaccttttcccggcggcggcgctcaggacaggggtgagagacacgacgtgaaggggagggcggatgccaccaggcaccgagcacgacttcgaggcctttgcccgggccggtcagcgcaagctgtaccggaccgcgtacctgctgtgcgggagcgccgacggcgcacgcgacctgacgcagacgacgctcgcgaagctgttccagcactggcggcgggtgtccaccgccgaataccccgacgcgtacgccagaaccgtgctgacccgcaccttcctcgccgagcggcgacggcgcctgcgcgacctgctggcccaccggcgcgccgatccgccggccccgcccgagcacgccgacctgcgggtcaccctgctcgccgcgctggacgaactcccgccgcgggcccgggccatggtcgtcctgcgctactgggaggacctgagcgtcgagaccgtcgccgagctgctgcgctgcagcgagggcacggtcaagagccagtgctcacgcgccctgacgaagctgcgcgcgcggctcggcgaggcccacgtctacaccaccgagagctgaggagacgccatgggtaccaacgaggaccacaccgaggaccgggccacggccgtgctcgtccgaaacgcgatggcccgtgccaccgcggagctgcccgtcacggcggacctggtgggcccggcccgcgcccagggcctgcgccacagggcccgcgtccgggcggcgatcggcggcgcggtcctggccgtggccgggctcggcctggccggcgccttcgtcctgccgggcggcgacgacgacggggggccgaccggaagcaccggggtgatcgacgtggccgcgccgccgacgggctccgcaccgccgccgccggtccacctcgaacccagtccgggcgaatcgtcgatggccgacctgccgcccgccgaacgggcccggcaggagaacttccagaaccaggccgtcggtgtgctccagcagttgctgccgccgtcggtcggcaccgttcagcgggtcgacctgggcgtgcggcactaccagggcaccaaggacggcaagaccttccacatcgtcttctcggtgcggcccttcgaaccgggcaccgcgccccaggcctgccgcgagatcaagggcacggtctgctcgaagaccaccctgcccggcggcatcgaggccgccgcgtcgatctcgccgatcaacaacggcgacgtcaccgagtcccgggtctggttccgctacggcgccagcgacgtctccctgagcgtcaacccgcacgacgagtcgcacacctcggcgcccgtcaccgcccaacagctcctcgacctcgccgcgtcctccgctttcctcgacctggtcaaggcggccgaccgcgacccggtggaggagatgcagcgctcggtcccggcaggctgacccgcctagcgccgccgcgcccgccacaccaggtacagcgcggacgccagcgcggcgccccgcagcacccacggccacatcccgtgcagcgccccgctcagctggtcgtcggccagggtctcgccccacttgccgttcatccggccccacacccacagcaccgcaccggcgagcacggcgccgggcgggccgaagaccgcccatttccgctcggcgggccccagcacccgcgaggcgtacggaaggagccagcccaccacgagcagcagccagtagccggtgaccacgccgaccacgagcacggccgcggccagcagcaggaaggcgttcggccgcggccgggcggcggccgcggcggcttcgggcgcggcggcggccgccgcctccttcttcgcgcgccgccgctcgcgcaggaaccgtacgaggctccgcgcgcccttctcgtcctgcgcgggcggcgccgacccgtccttgccggcctccgccggctcctcctccgggccctccttgaacaggtccgggatctcgatgccgcccgcgaacccctcgacctgcgggcccgccccgtacgtccccgggctcacccgccaccagtcgggctcggccccgccggaggggccgagctcgtccagcccggccaggtgcggcggcacgttctcgggctccgtcgcgggcaccgggggcgcgttccggccgcgcaggcggcccgggccccgctggacggggaccgacaggccgggttcggcgggcgcgggcgcggcagccgcgggggccgcggccgcgccctgccgggagccgggcgtgccgagggtgtccaggacctcctcgggcgtaccgatccgctccaggatgcgccgtacggcggcgggggtgtccgggtcgtacttggcgcgccgacggtcgatctcgtcccgcagccccgacaccagccgcatccggtcgccggaggacagctgccgctgttgcgccaagtccccgacgcggctcagatattcgtagaccagatggtcgctttcgatccccacgccccggctcctccctgaccccctgctccgaaggtagcgcgtgcgcccgtggagctgctgcgggcacagcggataccgttgaccggatggggaccggccgactgaccggccgacgcgaccaggaggcgactgtgcccgaggcaagcactgcggcgggatccgccggcgggagcccggcgggaagctccccgcgctcactcgccgaggcgctgcgcgcccgtgacgacgcggcgctcgcggccctgttgcgcgcccggccggacctgctcggcccggttccgggcgacgtgacccagctggccacccgggccgggacccgggcgtcggtggtgcgtgccctggaccggctggaccggttcgccctgcagaccgccgaggcgctcgcggtggccccggatccgtgcccgtacccggtgctggaggggctgctgacgggcggcgaggacgaacgggcccgcgccgcgctccccgacgccctggccaccctgcgcgaccaggccctggtgtggggcgacgaggaccggctgcggctggtccgcacggcgcgcgagctgctggccccgtccgcgtcccggccctcgcccaccgggctgggtccgaccgtcgccgaggccaccgccgggatgtcgccgacccgggtgcaggagatcgtggcggccgtcgggctgcccgccacccatgacccggtgtccgcggtggcggcgctgaccggcctgttcaccgacccgcagcggatgtcggcgctgctcgacgaggctccggcggaggcgcaccaggtactggggcggctcgtgtgggggccgccgtacggggaggtcaccccgaatccgacgccgccggtgcgctggctgcgcgaccgggggctgctgctgcccgcgacggcgcggaccgtggtcctgccccgcgaggtggcgctgcacctgcggggcgggctcgcgcaccgggacaccgcgcccgtggccccgccggtgcccgcgcaccgcgagcaccgtccacagcttgtggacgcgaacgccgccgggcaggcgctggccgcgctggccaccgtcgaggagctggtgaagtcctgggagcacaccggtccgccggtgctgcgggcgggcgggctctccgtacgggacctgaagcggaccgcggcggcgctggacacgagcgagcagcaggcggccttctgggcggaactggcctacgcggccggtctgctggccagtgacggcgaggccgacgagcggtacgcgcccacccccgccttcgacgactgggtcgaactgccgcccgccgagcgctggtcggcgctcgcggcggcctggctgccggcgacccgcacggccccgctggtcggcgagcaggacgccaagggccgcacgctctccgccctcggccccgaactcgaccgctccgccgcccccgaggtgcgccggcgcgtgctggaactcctcggcgacctgcccgagggcggggcccccgatccggagacgctgctggcgcggctcgcctgggagcgtcccgtacgcggtgcgagcgatctgcgggcccggctcgcgcagtgggcgctggccgaggcggaggtcctcggcgtgaccgggcggggcgccctgtccgggcccggccgggccctgctggagcaccgcgacccggcgccgctgctggccccgctgctgccggaaccggtggaccacgtcctgctccaggcggacctgacggcggtggccccgggcccgctgcgccgcccgctgggcgacaccctggccgtgctcgcggacgtggagtccaagggcggggcgacggtgtaccggttcacgcccggctcggtgcgccgggccctggacgccgggcacgcggccgccgacctgcacgccttcctcaaggagcacagccgtacgccggtgccgcagccgctggcctacctgatcgacgacgtggcccgccggcacgggcacctgcgggtcggcgcggcctcctcgtatgtgcgctgcgacgacgacgcgatgctgggcgagatcctggccgacaagcgctcggccgggctggggctgcgccgcctggcgccgacggtgctggcggcgcaggcggatccgacggtcctgctggaggggttgcgggcgatgggctacgcgccggccgcggagtcccgtaccggcgacgtgctggtggcgcgggccgacgcccaccgcaccccggcccgttccgcgcccgtaccggtgccggagggcccgccggtgccggacgccacgctgctggcggcggccgtacgggcgatccgcgcgggcgacgtggcggcgacggcggtgcgcaaggagcccgcgacggcctccgccgccggggtgccgggcgaactcccgcgcacgagcgcggcggagaccctggcgacggtgcaggcggccgcgctgaccgggtcggcggtgtggatcggctacgtgaacgcggagggcgcggcgagccagcgggtcatcgcgccggtccgggtggagggcggcttcgtcacgggttacgaccacacggcggacgaggtgcggacgtacgcgctgcaccggatcaccggcgtcgcggaactggcggacgaccacctctgaggcagcgccccacccgggggcgcgggggtcagtcccggacgatcaggacgacgaagccggcgacggcgcccagcagcagggcggccagggcgtggcgggggcggttctcgcgcagcaccggaaggtggtggtcggcggagaagcggcccgggccggtgagggtgagggcgatgaccgcggcgaacagcaccacttcgagttccacgcctttgggcgggaagtaggcgctcaggccgcggacgtcgatgatgttgatgaagacaccggtcagggccgctccggcgagcggggtgagcagaccgagggcgaggccgaggccgccgagggtctcggagaggccggcgatgacggccatggcgtccccggcggggtagccggccatcgtgaagcccttgccggtcgcggtgaggcccggaccgccgaaccagccgaagagcttcatcgtgccgtggccggccatgctgaggccgacgacgagccggagcaggagcaggccggcgtcgtgggtgacggtggtggcgggggccgaggtggtgctgaagagcggctggtcccagcgcgcttgcgtcatgagggtccgttcgttccgacgtcgccggtgggcgcctgcggggcctgggtgggggtgcctgggggcctggggtggctggggtggctgccaccctaggacgcccggccgcgccggacgggccgcaacatcgcctccccccccccccccccccccccccccccggcccccggcgtctacccgttcggccctggaacgcctgaccacaccccgccgccggccacccgcctcacctgggggcgtagtcgaccagcccggcgtcgaagggccacacctcgcggagccagtgggtgatccgctcgtggacccgcgtgtccagcgcggcccggtcggcgcgcacccagtggctgacggacacccggccgggggcctcccgggaaccgtggatgtagaggcagccgatcacgtcgccctcgccctggccgtcaccctcgcctccgccttccaggaggctgtaggcgaaggcgacgcgctcctcgaactcccgcgcgtgccggaccaggtcggccaggttcgcctcggcggacatccccgcgaccggcggccagccccgtcccacgaacccgggcgtcgccctgatgtgggcgatgctcccggtccaggcggcgaggtcccgctcgttgtgctcggcgccgagcggctccagccggaagccgtcggcgacgagggtccgcggcaccgcgaagtcggccggtacgagaggctgctgatcatggctcatgccaggacggtacgcgcctgtgccgccagggccagcagcttttccaccggccactggtcgtccgcgtgcaccccgtacccggcggccagtacgcgcccgtccggcgcgatcaggaagtcggcgggcagccccaggcgcccgccgccctggacgagcttcggcggcttcgcccggccgcgcaggatgtcgagcgtgccgacggcgatcgcccgccaggcgcgcgcggccagcagggcgcggtgggacgactccacgccgaactccgcgtacagccgcttgcgggggtccgcgatcacggcgaagggcaggtcggccacgtgctcgcgcagttcaccggcggcggagtggaagaccacgacctcccggatcccggcggcttctatctcggcgtgccgccggaccaccgagcgcaggtgcagatggcagatggggcagccggcgaaccggcggaactggaggtggacgaggtgtccggggtccgggacggccacgggcgccccgtccgcgacggcggtgagggtgcgggtacggacgatggaaccggtgtcgagctgcactggggcctcccctgtaggcgtatgccgtacacctacagcgtaagcgtatgccgtacgctgtcaacaccatgccgcgcccccgctcactcaccccggaccaactggccgccgcggccctcgccgtgatcgaccgtgagggcctgtccgggctgtccatgcgcgccgtcgccgtcgaactcggcatcagcaccatggccctgtaccggtacgtcgcggaccgcggggaactggaagccctcgtcgtcgaactcgtcctcggcgccgtcgacagcacgccgccgcccctgaccgccggcccctggcgcgcccgcgtcaccctcctcgtcgaccggatgcgggacaccgtcggcgcgcaccccgccgtgctgccgctcaccatgagccaccggcaccgctcccccggcgtgctgcgctggggcgagaccgtcctcggggtgctcggcgaggccgggttcggggccgaggagcggatcatcgccctgcggaccctgctcgcctatgtgatcggcgcgatccagcaggaacacctcggcgccctctccggcgcgggcaccgccgcgatcgccgaactcccggcggacgagttcccctacatgaccgaggccgccctcggcgcccgctccctcaccccggaccgcgagttccacggcggcctcgccatgctgctggccggtctgggccgctgaccctccgaagcgccgtgttcccagcctccgccccgtacggcacactggaggtttgacctgaatgaaacggggcgccgcgcgtgaatggtccactcatcgtccagagcgacaaaaccctcctcctcgaagtcgaccacgagctcgccggagccgcccggcgcgccatcgcccccttcgccgagctggagcgggccccggagcacatccacacctaccggatcaccccgctcgggctgtggaacgcccgggccgccgggcatgacgccgagcaggtcgtcgacgcgctcgtcgagtactcccgctaccccgtcccgcacgcgctcctcgtcgacgtcgccgagaccatggcgcgctacggccgcctgaccctttccaagcaccccgtgcacgggctggtgctgaccagcaccgaccggccggtgctggaggagatcctgcggtccaagaaggtcgccccgctcgtcggcgcgcggctcgacgccgacaccgtggccgtgcacccctccgagcgcgggcagatcaagcagaccctgctcaagctgggctggcccgccgaggacctcgccggttacgtggacggcgaggcgcacccgatcgagctcgccgaggacggctgggcgctgcgcccgtaccagcagcaggccgtcgaaggcttctggcacggcggctccggtgtggtcgtcctgccctgcggcgccggcaagacgctggtcggcgccggggccatggcgatggccaaggcgacgacgctgatcctggtgacgaacaccgtctccgcccgccagtggaagcacgagctggtcaagcggacctcgctgacggaggacgagatcggcgagtactccggtacgcgcaaggagatccggcccgtcaccatcgccacctaccaggtcctgacgacgaagcggaagggcgtctacccgcacctggagctcttcgactcccgcgactggggcctgatcgtctacgacgaggtgcacctgctgcccgcgccggtcttcaagttcaccgccgacctgcaggcacggcgccggctcggcctgaccgcgacgctggtgcgcgaggacgggcgggagtcggacgtcttctcgctcatcgggccgaagcggttcgacgccccgtggaaggagatcgaggcgcagggttacatcgcgcccgccgactgcgtggaggtccgggtcaatctgacggagtcggagcggctcgcgtacgcgaccgccgagacggaggagaagtaccgcttctgcgcgacgacggcgacgaagcggaaggtcaccgaggccctggtcgccaagcaccgcggtgagcagaccctcgtcatcgggcagtacatcgaccagctcgacgagctcggcgagcacctggacgcccccgtcatcaagggcgagacgtccaacgcgcagcgcgagaagctcttcaacgccttccgcgagggcgagatcagcgtgctggtcgtctcgaaggtcgcgaacttctccatcgacctgccggaggccaccgtcgccatccaggtgtcgggcaccttcggctcccgccaggaggaggcccagcgcctgggccgcgtgctgcggccgaaggcggacggccacgaggcgcggttctactcggtcgtcgcgcgcgacacgatcgaccaggacttcgcggcgcaccgccagcggttcctcgccgagcaggggtacgcctaccggatcatggacgccgacgagctgctggccagcgactgactccggcaggcgcgggcggtcaggacggccagtaacggggcgcaccagacccacagcggcggccagtcgagcacgagggcccgggccgcgtcggccaggtgccgggtccagaacgcggcggaggcctccggcaggaccagcagcccgagcagggcggtcccggccgaggccgccagcgcggtgagcccggcgcggacgcggcgggtcagcaggaggtaggcggcgatggccgccggggcgagggtgatcccggcggcgacgcccagcgcgaagcccttgccgagggcggaacggggccggccgaggtcccacaggaccaggcaggcgagagccaggttgatcagaccgggcagcggtgcctggaacagcggctgcagccacagcccggcgatggtggcggccagcacgggcccgggccgggaccgaagtcccgcgaggcggcaggacagcgtgatcagcagggcgagcaggccggcgttgccgaggacgaggacggccttcagcgcgccgctcggcagccacgcggcgggcgtgaagaggatcgccgcgaacggcggatacgtggtgggcggcccccactcggcggcggagaaaccctggacgagggcgtcggccaccgggatgcgcagggcgatgcagagcacgcccagcaccagcagcgagccggtcagcagcacaccggcgaacgacgacggtgagtggctgggaacggtactccgggtcacccgcgtgaccctagtggatcagtggacgtgccgcgcggggcccgaggtcagtggcgtatgacgcccgcgtcctcggagtactcaccgaggacgacgacgctcacggcggtcgccgcgaagatcttgacggcgcgcagcatgccgccgaagccgttgcgcggaagggagtcggagtcggcgccgctaggacggctgccctggatcgaggtgaaggttgcggggctcatggatccatggtgcgtttccgcgccgtcccgcacatcgctcccgggagggaacctcacggccctccgggtcctcctcccgtcgcatgcgtacccctaggggtggataccgaggtctgacactccccggtacgacgcctggtacgacgcccggtacgacacccctccggatgcaccgggaccgaccgggacggaccctgggaaggtccgcggtgccggcgaccacgccatgggagtgatccgcatgacccaccgttcccggacccagcgcctcgcgctgctctccgcatcgacagccctggtcacagccgggctgctgccgtccaccaccgcgttcgccgcccctgcacccgccgcggccgccggcgttgccgtcaccgccgccgcagcgcccacacccacgccgccgcccacgcaaccctcccaggccgcggtgaagaccaccgatccccccagcggcatctcggccgaactccccgggaaggccaaggtccgctccggctccatccccttggacggcaaaaccgtcggcgcccgcgtgtacggggtggagaccccgggcggagccaccggcttcgccgtctacgacgtgccgggtgaccgtcttccgctggaggacgccctcaagggcttcgtgaacgcgtacggcctgatgggcggcgggacgctgaccagcgaaaacgtccggaagacgaccgtggacggccacccggccctcgacgcgaccctcaccggcgtggacggcaccgaggtgttggccggctccatccgcctcatctccgacgacgaccacgtcatcatggccctgaccttcgtccccgaagagaacgagaagaacctgaacgccatgcacaagcagctcctcgactcgctgcagatcccctgatccgccaacccgcccccgtttattcgttcgcgccgcaccgccccggtggctagaatctccgctcttgccgcctcccgccgcctcatcggggagagccgccctccggccggaaaccggcgggccatctgttccgcatccagcagctggaggcagttccgtgcccgcgcacgcccccgagaccacgtacgacgacccgtccgcgcccaccgacccgctgggccgcgaacgggcccacctcaccgcctcgcgttcggccctgcgcgccatgcgcgaggacgtcgagtccctcgacatccgcgacgtcaccgcgaactgggtcaacgcgatcgtcctccaggcccagatcgacgaccgcatcaaagccctcgccgacctcgcccacaccccgctcttcttcggccgcctcaactacctgcacgcaccgggcgcggagctcgccgagggcgcggagggcgagcagttctacatcggccgccggcacgtccacgacgccgacggcgaccccatggtcatcgactggcgcgcgcccgtctcccagccgttctaccgggcctccaagaccgacccgcaggacatcgcgctgcgcaggcgcttcggttacaccggcggcgaactgacggcgtacgaggacgagcacctgtccgaccccggcgaggcggccgcggtcagcaagctgctccagcaggagatcgagcggccgcgcgtcggccccatgcgcgacatcgtcgcgacgatccagcccgagcaggacgagatcgtccgctccggcctgtccggttccgtctgcgtgcagggcggccccggcaccggcaagaccgcggtcggcctgcaccgggtcgcgtacctgctctacgcgcaccgggaccgcctcgcccgcacgggcacgctcgtcatcgggccgaaccgttccttcctgcactacatcgagcaggtcctgccggccctgggcgagctggaggtcaagcaggccaccgtggacgacctggtcgcccgcgccggcctggaggttcgcggcacggacgccgccgagaccgccgtggtcaagggcgacgcccggatggcggtggtgctggaccgcgccgtccgctcgcacgtcacccgccccacggagccgctgatggtggtccgcggctcgcgccgctggcgggtaccggcctacgagctggaggagatggtcgaggagctgcagaagcgcgacatccgctacggcgcggcccgggaggccctgccgcagcgcatcgcgcacgcggtgctcgtcaggatggagcaggcgggcgaggcccccgacgaccgggtgcaggacgcggtggcccgcaacgcggcggtgaaggcggcggtcaaggagatctggccgccggtcgaaccggcgaagctggtcctgcgcctgctgtccgatcccgggttcctcgcgctgcacgcggcggacgtcctcacggaggacgagcagaagctgctcctgtggccgaagccgttccggagcgtgaagtcggcgaagtggtcggcggcggacctggtcctgatcgacgaggcggccgacctggtggaacggacgcattcgctgggccacgtggtcctcgacgaggcgcaggacctctccccgatgcagtaccgggccgtgggacggcgctgcacgaccggctcggcgacggtcctcggcgacctggcgcagggcaccacgccgtgggccacgcgcagctgggacgaggccctcacgcacctgggcaagccgcaggcggtgctggaggagctgacggcaggcttccgcgtgccgcgcgaggtgatcgcctacgcctcccggctgctgccgtcgatctccccgggcctggccccggtgtcctccgtgcgtgagaccccgggctcgctgcggatcgtggagagcgcggatctcgacgcggaggtggtcggcgcgtgccgggactccttggcgttcgagggctcgatcgggctgatcgcggcggacgcgcggatccccgtcctgggcgaggccctgctggcggcgggcctgccgtacctgtcccccggcgaggagacgaccgccgagtcccggctgacgctcgtgccggcgtcgctggcgaagggtctggagtacgactacgtggtcctggacgagcccgcggcgatcgtggacggcgagccggacgagcggacgggcctgcgccggctctacgtctgcctcacccgcgcggtctcgggcctctccgtggtgcacacggcggccctgccggaggcactgctgccctgacctgcgggtccgcttcctggggatccgccccggacgccgcgcctcaaacgccggcgaggctggattttccagcccctccggcgttttgaggagcgggggtccgggggcagcgcccccgtcaggacagggcggtgcgccactccgcgacggccgccgccgagacggggcggctccatccggagggacgggccgcgccgccgatgtggaaggcgtcgatcccgcccgcgcgcagcaccggcacgtgcgcgagcgtcagcccgccgcccaccaggatccgcggcccgtaccccggctcaccaccccgcgccgcctccgccagcagcaccggcagcccggcctccacccccgccgccgagcccgccgtgaggtacgtgtccagcccgggcaggtccgccagggccttgcgcagctggtcccggtccgccgcgcggtcgatcgcccggtggaaggtccagcggcagccgtccagctccgcgacgaccgcctcgacggcggccaggtcgggggcgccgtcggcgtccaggaagccgaggacgaactcccgcgcgccctccgcccgcagttcccgtgccgcccgaaccaggacggacacgtcgccggccgcgaaaccgtccgccttgcggagcatcacgcgcagcgggatgtcgaccgccgccctgatcgccgcgaaggtctcgcgcggcggggtgagcccgtcggcggccatgtcggtgaccagctcgagtcggtccgccccaccggcctgggccgcgaccgcgtcctccacgtcgagggcgatcacctccaggagcgcacggttgctcattcgatcccatccttcttcggaacgctcgggaaaactccggaaaataggtctagtccaatattcagaatacgggcctccgcccgcccttcaccagcacaatcacgccaccccacaatgtgcccatggacacaggcacccagagcagcgacacccacccggacaccgccgacctgcgggcccgctggcaggcggccgtcaccgcggccggagcccccgccgaccgcgatcccgcgccctacgccgaccggctcctcaccgcctgggcggagccgcagcgccgctaccacaccaccgcccacctggccgacgtactcgcacggatcgacgtactggccccgcacgccgccgatccggccgccgtccggctcgccgcctggttccacgacgccgtctaccgccccgaccggtccgagaacgaggagcgcagcgccgccctggccgagcgcgccctccccgagctcggcatcgaccccgcgcgcaccgccgaggtggcccgcctggtccggctcaccgtcacccacgaccccgcccccggcgacaccgacggcgaggccctctgcgacgccgacctggccgtcctcgccggggcacccgacgcctacgccgcctacgcggccgccgtccgcgccgagtacggcttcgtcccggacgacgccttccgcaccggccgagccgccgtactacgccagctgctcgacctgccgaggctcttccgcaccccctacggagccgcgcactgggaggccccggcccgcgccaacctcgccgcggagctcgccgccctcacggcaccggaaacgcctcggggaatttgatcgcgttcgcgctggttggtgacagtcatgcccgcttcagccgaacgcccccgcatgcccgtctccgtctacgtcctcggactgtccgtgttcgcgctcggcaccagtgaattcatgctctccgggctgctgccgcccatcgccgaggacatgggcgtcaccatcccgcaggcgggcctgctcatatccgcgttcgcgatcggcatggtcgtgggcgcaccgctcctggccgtggccaccctgcggctcccccgccgcaccaccctcatcgctctcatcagcctcttcggcctcgggcaggtcgcgggcgcgctggccccctcgtacgagctcctcttcgcctcccgcgtggtctccgcgttcgcctgcgccggcttctgggccgtgggcgcggccgtcgccatcgccatggtcgacaaggaccagcgggcccgcgcgatggccgtcatgatcggcggtctgtcgatcgcgaacgtcctcggcgtccccgccggcgccttcctcggcgagcacctgggctggcgctccgccttctggtcggtcgccgccgcctccgcgatcgccctcgtcggcatcctggcactgatcccgaagatcccgctgcccgccgagaagccctcgctggggcgcgagctgcgcatctaccgcgaccgccaggtgtggctctccatcggtatcaccgcgctggccgcgggcggtgtcttctgcgccttcagctacctgtcaccgctgctcacggacgtggccgggctggactcgcggtgggtcccgtggatcctcggcctcttcggcatcggcgcgctcgccggcaccaccgtcggcggccgggtcgccgacgcgcacctgttcggcgtgatgatctggggcatcaccgcctccaccgtcttcctcaccgcgctggccctgctggcctccaccgccgccgcggcgatcgccctcgcgttcctcctcggcttctcggccttcttcaccgccccggcgctcaacgcccgcatgttcaacgtggccggcgccgccccgaccctggccggcgccaccaccacggccgccttcaacctcggcaacaccggtggcccctggctcggcggcaccgtcatcgacgccggcctgggcttcgccgccaccgcctgggcgggcgccgccatgaccgtcaccgcgatcgccctgaccgtcctcgccctgcgcctggaccgccgtacgcgcccgcacaccacccgtgtggtcgccggaggcggcaccgccgccgcgacggccaccgccgcgacgacccccgtcgaggagcccgcccgcgcgtgaccgcggccccggtcgccgcccccggccccggttcctacgatgggaaggtccgctcggggatccggagaccgctcgccgtcaccggcggggacgtctgccagaggtgatcctccatgggccggtaccggacgcccaccgtcctggcagccgcctcgctgctgctgaccgcactgtgcgcgggccaggcccccgccgccgccccgcagggccgcgtcgacatcgaccccgtgaccgccgggcggctcgacgacgcgatcaccgcggccatgcacaaggccgccatccccggtgtgggcgtcggcctgtggatcgacggcgaggccccctacgtacgcgccttcggcaccgccgacaaggccaccggcgtccccatcaagaccgacatgcacacccgcatcggcagcgtcaccaagaccttcaccgtcaccgccgtcctccagctcgtcgacgacgggaaggtacggctcgacgcgccgatctcgacgtacctcgacggcgtgcccggcggcgacgagatcaccgtccggcagctcgccgacatgcgcagcggcctcttcaactacaccgaggacccgcgcctgctggacgcctacaaggccgacccgcaccgcgcctggaccccgcaggagctgctggacaccgctttccggcaccctgccaacttcccgccgggcacgcgctgggagtactccaacaccaacaccgtgctgctcggcctgctcgtcgagaaggtcggcggccagcccctgcacacctacctccagcagcacgtcctcgaaccggccggcctggacgcgacctcgctgccgaccggcgcggagatcgcctccccgtacgtgcacggctacacgaacttcaccccggacggcgcgaccgtcgacgcctccacctggaatccgtcctgggcctgggcggccggcgcgacgatctccaccatcgacgacctgcacgcctgggtcccggccctggtcaccgggaagctgcccgacggcgaccgcctgctggagccgggcacccaggcccagcggctgcgcatgctgcccaccgggtaccccgacatcggctacgggctcggcatcgccgagctcgacggctggatcggccacaacggcgagctgcccggctacgagaccatcgccgtccggctcccgcaggcccgcgccaccctggtgatcgtggtgaactccgacgtcgacgggaagttcggcaacctgagctccctcatcgccaacacggtcaccaagatcgcgaccccggaccacgtctgggagctccctcccgcggcccaccccaacaccgtcccggagccgtccgcacctccggccccgaccccgagctcctaggcctaggccgccggccggcccttcgggcggcgcaggcccgccgcggtgaggcggcggacgagttccttgctgccgatctccaccgcaccggcgccgaccgcggccgcgtagcggtacgacggcacgtcgtagtggtcccgctcgaaggcccgcggcggacatccgatgcccgcggcgaaggcgtgcagctcctcgtacgagacgtcgctgaccaggtgcgaccacatgcggccatgacccggccaggtcggcgggtcgatgtagacggtcaccggcggctcaccggaggccgaagaccgggcccaggccgccgatcgcggccaccttcacgcccgcctccgagcacacccagtgcgggtccggtcccagctccggctccacgtccagcgcgtgcggttcgccgtggttgcagaccgggcacagcggccatcgtccgtacttctccagcagcgcgtccttcacatcctgtgcgacgagtccggcaaggtagtcgacaccctccggccactgctccacccaccaccggcggtgcgtgaccgagtcctcgacgagggagacgacatcggcgtcggcgacctcgcccgcggcgagatcggcgagaacaagtgcgcgcgcgacgtgcagcgcctgctccaggggggtcgcgtggtccatgcgcccattgtggacccgcgagggcccggcgctgaaggcccactttcgcgagggcccaatggcggattgaccgggcatcgccctgaaaataagtttcaggaatgagccagaacatgaaggaaactgccagccgcgcgtccctgcccgccgccgcaggccccgccgagaggcccgacccggccccggctcccccgccccacgccctccgggcccggatccgcagcctcggcccctccctcacccgctccgtgcaggccgtcgccgacgccgtcgccgccgaccccgccgcatgctcccggctcaccgtctccgccctcgccgagcacaccggcaccagcgaggccaccgtcgtccgcaccgcgcgcctcctcggctaccccggctaccgcgacctgcgcctcgcgctcgccgccctcgccgcccagcaggaatccggcgccgcccccaccgtcaccgtcgacatagccgtcgacgacccgctcgcggacgtcgtcgccaagctggcccacgaggaggcgcagaccctcaccgacaccgccgccgcgctcgacctcacccagctcgccgccgccgtcaccgcgctcgccaccgcccgccgcatcgacatctacggcgtcggggcctccgccctcgtcggccaggacctcgcccagaagctgctgcgcatcggcctcctcgcgcacgcccacagcgacccccacctggccgtcaccaacgccgtccagctccgccccggcgacgtcgccgtcgcgatcacccactccggcaccaccggcgacgtcatcgaaccgctgcgcaccgccttcgagcgcggcgccaccaccctcgccctcaccggcggcccgaacagccccgtcacccgccacgccgacctcgtactggccacctccgccgcccgcgagacgcggctgcgccccgctgccatgtccagccgcaccagccagctcctcgtcgtcgactgcctcttcgtcggcgtcgcgcagcagacctacgaaaccgccgcccccgccctggccgcctcgtacgaggccctggcccaccgccacaccggcagatccagcccctccccgtccagcccctccggcgtttgaggagcggggtccggggcggagccccgatctcgaagcccagcccgcgcaccacccgcacccgcacccgcacccgccagggacccacatgaccgcgtacgaagaactccgcgcccagctggacagcctcaccaccgaggccttccgcccggaactcgccgagatcgaccggctctccaccctcgacatcgcccgcaccatgaacgccgaggacgccaccgtcccggccgccgtcgccgggcagctgccacggatcgccgccgccgtggacgccatcgccgagcggatggcccgcggcggccggctggtctacgcgggcgccggcaccgcgggccggatgggcgtcctggacgccagcgagtgcccgccgaccttcaacaccgacccggccgacgtggtcggcctgatcgccggtggcccgtccgccatggtcaaggccgtcgaaggcgccgaggactcgaaggaactggccgccgaggacctcaccgccctggacctcgggccgcacgacgcggtcgtcggcatctccgcctccggccgcaccccgtacgcgatcggcgcggtcgagttcgcccgtagccgcggcgcgctcaccgtcgggctctcctgcaacgcgggatccgccctcgccgcggcggccgaccacggcatcgaggtcgtcgtcggacccgaactcctcaccggctccacccgcctgaaggccggcaccgcgcagaagctcgtcctcaacctcatctcgaccatcacgatgatccgcctcgggaagacgtacgggaacctcatggtcgacatgcgctcctcgaacgagaagctgcgcgcccgcgcccgccgcatcgtggcgctggccaccggcgcgcccgacgaggagatcgaggccgccctgaccgccaccggcggcgaggtcaagaacgccgtactcgtcgtcctcggcggagtcgacggcccgaaggccgccgaactgctcaccgcctcccagggccacctgcgcgccgccctcgaactcgccctcgcccccgcccgctgagcgcgcccctcgacccccgactccccgacccctgcccccgtcaccgagccaaggcgatcccctatgtccactgacaagcaccgcgccacagccgccgcgatccttccgctggtcggcggcccggacaacatctcctcgatcgcgcactgcatgacccgactgcgcctcacgctgcgcgaccgctcgctggtccaggacgaggccctgcgcgccctcccggcggtcctcggcgtggtcgaggacgccacgtaccagatcgtgctgggcccgggggccgtcgcccgcgtgaccccggagttcgaggcactcgtcgaagaggcccgcgcggccaccccggccacaccggccgccccggccgccccggccgcctccggcgcgatcaccgcggacgacctcgccgcccagggcgcggcgctgaaacaggctcagaaggccaggaacgccacgcccttcaagctgttcctgcgccggatcgcgaacatcttcgtcccgctgatcccggcgctgatcggctgcggcatcatcgccggcctgaacggcctgctgacgaacctcggctgggttccctccgtcgtccccgccctcgccgcgatctcggccggtttcatgtccctgatcgccgtcttcgtcggccacaacacggccaaggagttcggcggcacgcccgtcctcggcggcgccgtcgccgcggtcatcgtcttcccgggcgtcgcgaagatcgacgccttcggcctggagctcaagcccggccagggcggcgtcctcggcgcgctcgccgccgccctgctcgccgtccacgtggagaagtggtgccgcaggtgggtccccgaggccctggacgtcctcgtcacccccaccctcaccgtgctgatctcgggcctggtcaccctcttcggcctgatgttcctcgccggcgaggcctccaccgccatcggcaccttcgcgaactggctcctctccagtggcggcgccttcgcgggcctggtcctgggcggcctcttcctccccctcgtcatgctcggcctgcaccaagccctgatccccatccacaccaccctcatcgagcaggacggctacaccgtcctgctgcccatcctcgccatggcgggcgccggccaggtcggcgcggccatcgccgtctactaccgcctcccgcacaacggctcactgcgcgccaccgtcaggtccgcgctcccggccggcttcctgggtatcggcgaaccgctgatctacggcgtctccctgccgctcggccgccccttcgtcaccgcctgcatcggcggcgcggccggcggcgccttcgtcggcctcttccaccaactgggcgtcgccttcggctccaccgccatcggcccctcgggctgggccctgttcccgctgctcgacggccgcgccggagcgggcaccaccctcgcgatctatgcgggcggcctgctggtcggctacctggtgggcttcgccgccacctacttcttcggcttcagccgcgcccagtacgcagcgctcaaccgcagcgaggacgaaccccgggcgaccccggcggaccggcccggcacacccgccgccccgggaccggccgccggtcccgagcccgcggatccctccgtactcacccgctgaacgggacggccggcccccggcaccccggcactacgatcgcggccatgagcgacagcgcgatcatcgtcgcggagctgaccgtccccgcccgggaagcccccgcgcgagcggccgccaccgccgcctggctcctcgaccagggcgtcatccggcccgaggaccgccccgacccgctctggcgcccgagcccgtacgtccccggacccgccgcccaggcggccctcgccgaccgccgccacgcccccgacgacgccgtcggcgacggcgtcgacctcctcgaccagcgccggatccaccaccccggcgggaactacaccccgccgggctgcccgcactgcgccgtcccgctcgacgaggacgcgcacaccgtgctgatccggacctggttcgaccgggaggagcccctcgtgacctgcgcacactgcggggccgccgcgctcctgggcgactggaccggccagtgggccgtgctcgtctcccacctcgccgtgcgcttcaccaactggccgccgctcggcgacgccttcctccgcgagctccacacccgcctcggcccccgctgccgcctgatccaccaccggctctgagccgccccgccccgccgccgacgggcccggtccggcccgccatgctgtgcggatgcagctccccgccgacgccgtcgccgccacggtccgtatcgacgtcgtacgcatcaccgccggtcccgagcggcacggcgacccgatgaccgggcccgtcgtggggcactgggagggtcccgccgtcgcggagatgctcgcggccgtacggaagatcccctccgccggcctcaccctgtgcgggttcgcccccggctggggcatccgcgcctacgccgaggcggccgcgacgcccctctacgaagcggcgttctgctacggctgcgacatcgtctggctctggggcccccgcgtcccggagccgctgcaccgccagaccttcgcctcggactcgccctacgcgctgttcctgcgcatgcgcatgcgcgcggcagcggcctgaccgtaaaggggacacgctcatacgtcacggcgccgcacgacgagcacggcgacggcgaccgcgatcaccggccagagcaggtacacggtccaggagccggagaccgtggcggcgtgaccgagggctcccgggtccggctcccagtcctggaccaggcgcttccaggcggccgacaccatcgcgtggttgacgtccgccgaccagcgctcgccctccgagaacatggggggcagcatcagcaggatgaagaccgtggtgaccatggtcgcggcgctgtgccggatcaggacgccgaggcccagtccgatcagtgcgcagaccggggccagcaacgcggatgccaccagcgcccggagcacaccggggtgggtgagcggaaccccggcgtgccgcccgccgaggacggcctgggagaccaggaaggaaccggtggagacgaccgcgccgaccgcggtccacagcacggcggtgacggccgccttggccagcaccaccgagccgcgggcggggacggccacggtggtggtgcggatcaggccgctgccgtactcgctcaccacggtgagggcgccgacgctgccggcgacgagtatcagcgtccagtagccggccggcggataggcggcgtagggcaggaagacggcagggccggaacggtcggtgccgcccgcgagcgtggtcacggcggaggacccgatgacgaacaggacggtgagggcgatcgtccacggcgtggagcgcagggaccgcattttgatccactcggaggcgaccaggtcgccgaagcgggcggacggcccggtgacgggggcggccggggggacggaggcgagcgtggtcatcgggcctctcctgcctggtattcgacgctgtcggcggtgagttccatgaaggccgcctccagtgaggcgctgcgggtggtcagctcgtccacccggatgcggtgctcgaaggcgagcgctccgatccggtccgccgggagcccggtcacggcgagcctcgcggcgcccgccgggccttccggctcgaccgccgcgcccgcagcggtcagcacggctgccagttcggcggtctgtggtgtccccaccacgacgctgctacgggtgctgcgcgccgcgaagtcccgtaccgactcggcggcgacgaggcggccccggccgatgacgaccagctggtcggcggtgttctccatttccgacatcaggtggctggagaggaagacggtgcgcccctcggcggccagccgccggaacagccggcgtacccagagcacgccctccgggtccataccgttgatcggctcgtcgaacatgagcacgggcgggtcgccgagcagggcggtggcgattcccagccgctgcttcatgccgagggagaatccgccgatgcggcgcttcgccgcctcggccagccccacctcctgaagcacctcgtccacccggcgccgcgcgatgccgttgctgcgggccagggcggacaggtgggcggcggcgctgcgtccgccgtggacctgtccggcgtcgaggagggcgccgacgtgccggagcccgcgccggtggtggtggaaggggacaccgctgacggtggcggagccggtggtgggcgcgtccaggccgaggatcatccgcagggtggtggacttgccggctccgttggggccgaggaatccggtgacccggcccggccgcacggtgaaggtcagatggtcgacggccgtcctgccgccgtagcgcttggtgagttcgttgacttcgatcacggcacccacactgtcgggaggaccaccctccggacatggggccgtggacggcaatcccccggccggctcaccccgcgggtgtaagcccccgggccgatgccgcgcgggggcggggcgggagccgcagtcgcttccgccgctcgccacaattgcgggcgcggccggaatcctcgggtccttcatcagtgcggaaccagcgaacgtgaaaaccctgggcccggccctgcaccgccggccgggcccaggagaactcacggagtgtcgcgcccgtgagcgagaccggtcgggaatcatgtccggatgatcaactcgataccccccgtggtcccggccggccggatgcgcgccctgccgcagcccgagttcgaactgccgggcggcatgctgctgcgcccctggacggcctacgacgtccccgcgctcgtcgaggcctgccacgaccccgacatccggcactggaaccggcccgacctgctcaccccggccgaggccgaggaacggatcgcccgctggcacacccgctggcaggacgaggcggccgcgacgtgggccgtcgcccccgcctccggaggcccggccgtcgggctcatcggcatcgccgacctcgatctcgcgggcggcagcggcgagatcctctactggctgctgcccgccggacgcggccgcggggtcatggcgcccgccacggaacgcgtcggccgctgggccttcgaggacctcggcctgcaccgcgtacggatcacccactccgtggccaacccggcctcctgcgccgtcgcgacgaaggccgggttccccctggagggcaccatgcgcggcgccctcctgcacgcggacggctggcacgaccaacacctgcacgcccgcctgagcaccgactgagcaccgaccgaggtgggggccgcgcctcacatcgagcccccgccggcggcctccgtcaggaagccggccaggtcgtccacgccgtagccgagcctcgggccgcgctcggccgccatcagcagcagctgcccgacgatctccgcgccccagccgtccggaccgtcctcggaccactcccacagcttgtcgatgccgagaccggtcatgagcagcccgtaccgggtgcggatctccgcgcacagctccgccaccgcgtcgagcagccgcccgcccggccgctcgcaccgcagcccgaggcacccgccgaggtcctccaccgcgcacccctggggcggggccgccctgagaccctcgtagcgcgggtcgtcgaaccccggatagccctccagcgggcagtgcaccagcgtgaaccgctgccagccggccggcggaggcggcttcggatccccggcctcgggcccgcacaccccgcgcggggcgagggccgtctccagaccgcgcagcttccagccgagctcgaaggcgaagttcaccgcctccacggcctcgctcacgagccccccgcccgctcgtgcagaacggccgccagccggagcgcggtgtcgaggttgcagcggccgaggtcgaccagcggcaggccgtaggtaccggcggccgagacccgctccacgtccagagaggggaacagcacaccgaccccggcgagcgactcccgcaactgccggacggcctcctcggccgcctgcatgcgctcctgtggggagagcaccatgacatgtcacctttccactctgagtattcaacttcttcacacagagtggcgacgcgctcactagcctttcaagtgcggaccccgcaacaaccgttcatgttgctcagggagttgccatgccacaaaagaacctcgatccgtcctcatccccccgcgccctcctgggggcggagctgcgcgtagcgcgcgaacgcgcgggcatgagccaggccgaactcggcgaacggctcttcgtgagcggcgcgttcatcggccagctcgaagcgggcacgcgccgtatgcacctggagttcgcccgccagatcgacgacatcctcgacacgggcggcttcttcgtccgcaactgcggggcggctgccgagtcgaagtacccggaccacttcgcggcggccgccgaagccgaagccctcgcgaagacgatccgggagtacgcaccgcagctgatccccggactgctccagaccgaggcgtacgcgcgcgaggtgttccgcgcgtaccagccgacggccacggaggagaccatcgacgagctggtcacgaatcgtctggccagggcctcgctgctcaatgacccaacaaccccactgttgtggtgcgtcctcgacgaggcggtcctgcgacgcgccggggaccgcccggcgatcctggccgaggcactgcggcacatcgcgcgcctgatccgctcctgccgggtcatcgtgcaggtcctaccgttcagcgcgggcgtccatgcaggcatgctgggctccctcaagctgatgtccttcgacgacgcgcccccgctcgcctacatccaaggcatgggcacgggccagctgttcgatgatccggccacggtcacccaacacaccctgacctacgatctcctcacggccaacgcgctgtcgccccgggagtccctggccttgatcgagtcggtggcggaggattacgaacatgaccagcaagcctgagtacgacctgtcggcagccacgtggcacaagtccagctacagcggcggcgacgggggcgactgcctggagatggccacctggcggaagtccacccacagcggtggcgacggcggcaactgcctcgaagtggccgactgtcaccccggcctcgtccctgtgagggactccaagcagcccgaaggcccgcacgtggtgttccacgcgcaggcctgggcccggttcgtcgggtcgctctgagcgatcagagaccgtcggtgaacagcagcttgttcgggccgttgttgctgaggttctggacgatgtccttcgtggacacctcgttcaggaagtccgtcacctccgccggcagcgcgttcgggtgctccgacttgtagagcgcggccacaccggtcacgtgcggcgcggccatggacgtaccgtccatggccacgctgccgccgcccagacgcgcggagatgatgtccttgccgggggcgtagaggtccaggcaggagccgtggttcgagaagtccgtctcctcgtcgaagcggttcgtcgcgccgaccgtcaccacgcgcgcggcggacgcgggcgagacgcggcaggcgtcgcggttgtcgttgcccgccgcgatgaccggcagcacgccccggtcggacacggccgtcgcggccgcgttgaccgcttcgagccggtcgccgcccagcgaggcgttcaggacggccggctgctgggcgttgcgggcgatccagtcgaagcccgcgatgatgcccgaccaggcaccccggttgtcacagccgaggacccggacgctgaccaggctcaccttgcgcgccacgccgaaggtctcgccgccgaccgtgcccgcgacgtgcgtgccgtggccgttgcagtccgcgccgttgcggccgtccccgatcgcgtcgaagcccgcccgtgcgcggccgccgaattcggggtggcggaagtcgatgccgctgtcgaggatgtacgccgtcacgccctggccgctgcggttggcgctgaagtcgttgtccagcggcaggaaccgctggtcgatgcggtccaggccccaggagtgggagggcgacttggtcccgatccccttcgcgggggtcggcggcccggtcaccgtcgcgtcctccgtcacggacgtcacaccgtgcgccccgcggacggacttcagctgctccgccgtgagggacgccgcgaagccgttgatcgtcctggtgtaggtgaacttcgccgccagacccagtcgcttcgcgaacgcccccggggagacgctcttgtcgagggtgacgatgtagctgcccgggatggcgtccgcagacgtgaggagcggcgccggggtcggctccgggctgtctgcggaagccgcaccggctccgaggggggtcagtgcgagcaaggcggtggcggtcagggctgcgaggtgacgcatggaaggaactccctgaagtgcgtggtgtgtcggcgtgggggagccgcccccgcggtctggagtcctccgcgggtgcggcccctctctacatcgggcaccgcctcggcgcgacttgaaccatcgtcgccacctggccgagcgtccgatcagcgcgtcaacctggcgtgccggacacagcagaaagggttaatcccttgtggcgcccgaaatgtgggccgttccagccggggtgtggaaacccgtgcgagattcacccgtacgtcccacccccacaccagtgagcgcgcggcccgtgcccgccgcgcacccgccacacccgccggcgtcgttgacccgcactgccgtgcgtgatgccctcgggccatgcgcatccgcctgagccgggccctgcccgtggccgccgccgtactggccgccgtcgccgcagtggccgccgtcgccgcccggcccgtgtcggcggccaccgccgacgtgccggaacccgtaccgcacacggcccccaccgccgaccacgccacgtacatcgtcaccgtgcggggggacgccgacccggccgaagtggccgagcgggtcggcgccaccccgctccacgtctaccgcaccgtcctgcacggcttcgccgcccggctgagccccgaccaggtcgaggccctgcgcgcgatgccggacgtcgagaccgtggaggaggaccgcggggccaccggcttctgaggcccgggcgcgcccgtagccggatccgggatcagagtccggcggtgtagagcagcttgttcgggctggccgggctgaggttgctcaggacgtccttggtggtctcggactccaggaattcggcgagggtctccgggtccgccgtggggttcttggccttgtagaggaccgcgacaccggcgacgtgcggcgcggccatcgacgtaccgtcgagggccacgctgccgccgccgagcttcgcggagacgatggcctcaccgggggcgtagagggtcacgcactggccccagttggagaagctggtctcctcgtcgtaccggttggaggcggcgacggtgaccaccttccccgcggaggccggcgagacgccgcaggcgtccttcgcggagttgcccgccgcgatgacgggcagcacgcccgccgcggtgaccgcgtcagcggcgtcgttcacggccttcgacagttcaccgcccagcgagccgttgagcacggccggctgcttggcgttcttggccacccagtccagcccggcgatgatccccgagtactcgcccttgccgtcgcagccgaggactcggacgctgacgaggctggccttcttcgcgaccccgtacgtcttccccgcgactgtacccgcgacgtgcgtaccgtggccctggcagtcggcgccgttgcggccgtcgttgatcgcgtcgaaaccaaacgtggcgcgggtggcgtcgggcccgccgaactcggtgtggtcgtagtcgatgccggtgtcgaggatgtaggcggtcaccccggcgccgttgccctccggggagaactgcccgtcgcccttgccgttggccttgtcccagtcgctctgctggtcgatccggtccaggccccaggacagggccggggcccgggtgcccgccgcggtgctctgcttcggcaccgactgcaccttcgcgtcctcctcgaccgacttcacccccagggcgttgcggacgatcatcagctggagcggggtcatcgggaccgcgaagccgttgatcgccgaggtgtagacgaacgtgggcttcaggcccagcttctgcgcggccttggccgcgtccacccccttctccagcgtcacgatgtacttgccgggcaccgggttggcggcggtcttcagcggtgccggggtcggctccggggccgcggcggaagccgtgccggcggcgaccggggggacggtgaggagggcggcggcggccaggcgtgcgagcaggcgcatgaaagggaactccctgacgttatgcggaaggcggcatgggggagccgccctcacggcaccagtgctcctgccggggcggccctcagctccatcgctgccacccgtgtgcagcttgaaccaacagctcacctggttgcccgtccccgcccgcgtcgacgcgcccggtcgcgcgccctgtgcagaaagggttgtcccgctgtgccgtacgggtcgtgccccgtcccgggcggccgtcggcccgccccacaagatcacccgtacggtccgccgccggaccagggggcgcacggacggtgcgccgccccgtgcccccgccacacccgcggacgtcgttgaccggcccggtcgcccgtgatggcctccctgcatgcgcatccgcctgagccgagccctgcccgtggccgtggccgtactggccgccgtcgccgtactgcccgtggccgcggccaccgccgacgtgccggaacccgtaccgcacacgcttcccgccgccgaccacgccacgtacatcgtcaccgtgcgggaggacagcgaccccgccgaagtggccgagcgggtcggcgccaccccactccacgtctaccgcaccgtcctgcacggcttcgccgcccggctgagccccgaccaggtcgaggccctgcaggcgatgccggacgtcgagaccgtggaggaggacggccgggcgagcggcgacaacgcccccggcgactactgggggtgggggcccggaggcaggtgaccgcggcccgccgccgtcaccagccgaagaccgggccgatgtcgaaaatcggcggcagcaggcccttgcggtccaggttcacgaagacgtacgagccgggcgggcccgggtagaaggtgaaccgctcgcccagcggcaggtcgcgcaggacggtgggctccgcccggcgcacgccgtcggccagacggcggtgggagaggtacgtccaccagcggtcggaggtcaccacgccgacttcgcccgggccggtcggggccagtccgcggatctgcgcgtcgccggcgcccgcggccgcgtgccagacgcgacggccgtcggtgagggagtaggcggacacgccgttcttcttgccctgcttcaccgcggtgaccagcaggtcgccggtcaggaccggggcgggctcggacagcaggtccccggccggacccgaggccggtacggaaccgcgcgcccggccctcggcgtcgaacagcagcaccgcgtccgtgccgcgctcggccgtctccgtgaggcgtacgaccggcggggcggcggacagcacccgcacctcgcgcagcctgctcaccgtcggcagcgcggtctgccaggcgcgggttcccgtacgggcgtcgacggccgtgatccgggcggagtcgccgcactcctccacgtacagggcatggcgctccgaaccgtcgacggccttcaccgtgcactcggcggggaccggggcccgccagagctcgtggccgccctccaggtcgaggccggtcaccgtgtcccggtccgcgacgacggcgctcgcgcccgccgcggccaccagcgcccggccggtgtcccgggtccaccgcgcgtggccgtcggacaggtccacggcgacgacctgcgagccgcacgtcccggggctctccccgtacgcgacgaggccggtgcccgacggggtcgtccggctgagcgcgcagagcggcgtacgctccggggcgggcagccgccagctcttgcggccctccccgttgtagccgacgaggccgtccctgcgggcccgtacgagcgagccgggctcgggagcccagacgccgaccggggccgccgccggatgcacgggctcctgccagcccgacaggtccagctgcgggccgcgcgcgtactcgaagcccagccagccgggccccagcgcggccagcgccgcgcagacggcgatcacgcggacgtgcaccggggcgcggcggtggccgcgcttcctcggcacccgccacagcagccacgcggccacggcgcacagcggggcgagcagcgcgagcgtgcccatgccgcgcgggcagctgtcgatgccgcacatgcggccgggggcgtcggcgaacaccagcttggtcaggaggaccaggtacagcgccgccaccgccgcgaacgccgcggcggcggcgaacgcgaggtagcccaagagccgtacgggccgccgtcgttccatgtccatgatccccccggaccgcagcctaaccgggggctccggagtcagagcgcggagcctccggtggcgtcgaccacacgcccggtcacccagcgcgcggcgtcggaggcgaggaagccgacgacgtccgcgatgtcctcggggcggccgacacggccgagcgcggagagcgaggcggcgtgcgcctcggcctcggcgttgccccgcagccagccggcgttgacgtcggtgtcgacgatgccgggggcgaccgagttcacggtgatcccgcgcgcgccgagggctttggcgaggttcagggtcagggtgtcgagcgcccccttggtggccccgtaggcgaggatctcgggcatcgcgatgcgggcggcgccactggagatgttgatgatgcggccgccgtcgcgcagccgcccgagggcctcctggacgacgaagaacggcgcccgtacgttcaccgcgaagacccggtcgaagtcctgctcggtgatctcgcccaacggaatgggcagtccgatgcccgcgttgttcacgatgatgtcgaccccgtccagccccagcgcgtcgtacgccgcccagagcgcggcggcggagcccgggctgccgagctccgcctggagggcgaaggcccggccgccgtcctcggtgatccgctcgacggtctcgcgggcggccgccgcgtcgctcgcgtacgtgagcacgaccgtgacgccgtcggcggcgagccgctcggcgatggcccggccgatgccccggctgccgcccgtgaccagcgctgtcctgttcatgaagtccccctcggattcggtaatgattactacagaatgaaggtagcacgacttccgtagcgatcattacataattacggaggtcagtccgggcgagccgtcaggcccgggcggccccgacgaaggcgcggatcagctccggcgacttcacaccgcgctcccgttccaccccgctggacacgtccacgccccacgccccggtggccgccagcgccgcccgcacattgcccgggttcagcccgccggcgagcagccaccgcccctcgggcgccgtgaagtccgccgccccccagttccacggcttgccggagcccgggtcgggcgcgtccagcagcagcaggtcctcgccgtactcaccgcagcgccgcacgcgctcggcggtggcccgcagcagggtccggccctcggcgcgcagcgcctcgaactcctcgggcccctcctcgccgtgcagctgcaccccgcgcacaccgctctcctcggcgaaccggcgcacctccgccaccgcctgcccccggaacaccccgaccgtgagcaccccctcgggcacccgcgcggccagctcccgcgcggtggcggcgtcgacggtccgcgggctgccgggcgcgaagacgaacccgacggcgtcggccccggccgccacggccgcgtcgacatcgtgcgcggtccgcagaccgcagatcttgacgaagagatcagccatgcgtccagcctatgcggaccggacggggcccggccgcgtcagcggcccacctgcgccgggcccagcaccgacccgccgatcgcggccgcgagccgggccgcgccggtctcgtcggcgtacgtgaagtgcacgtagagcgtgtgccggccgtcgggatgctcctcgttgatgccgagttccacccgctggttcgccgagtcccgcaccgcggacgggatcccgggggccgacggccagactccgtaccagagcatcgtggccgacccggcgcccagcgcgcgcaggaaggccggttcgacggggcccggagccgcgtacgtgtcgacggtcagcggcagttcggccgccagctcccggtcgtcgcggggcagttcggcgcccgtgaaccagacgtcccggtcccagtcgtacgagggctcgaacaggcccgtcggaaggagcgccgccagcccgcgggcctccgggacggtgagcgcctgcgcgcacagccacatctccgcgtcgagcggcttcatcagcccggacagcaggcgggcccgccgataggcgtcggcgaggtcgtcggtccggaacacggggtaggcgcgcgaacttcccaccgcccgctcagccccgctcgggctcgcccggcagccgcgcctgggcatacgcctcggcgggatcggaggtgcggtggacggggtacgcgacggaatggcccatgcccgtaccgtcacacgcccccacccacccgggccagcgcttttacccccccggtcggcggagagcgctccgcgggccgggcacgtgtctccccccgccgctagcctggaacgaggctcacgcccagtgcacggcacgccacgcggaggacacggtgacgatcatgatcgaacgggccacaccgatagagcaggcggcaccgccgacgttcgagacgctcctgcgcacggtcgcggagatggacacgccagacggcttcaaggccgagctcatccgggggaagatcatcgtgtcgccgttctcgtcgctgcgctatctgcgcagcatgcgtgcccttcgtgagcagctcaaggtccatgctcccgaaggccacgtcgccgagacctccccgttcctcttccggttccctgccgcagagcgggcctacggccccgacctgttcgtcgcggacgaggccgccttcgaggacgatggccgtcacgcggacagtgcggccctgtccttggtcgccgagttcacgtccacatccacgaaggacgtggactggaacgagaagctggaggtgtacggccaggtggtccccgtgtacctggtggccgatatgcaggcgaaagagatcacctgcttctccgaaccctcaccacacggctaccgctcccgcaagacggtgtccttcggcgaggagctgcacgtccccgaacccttcgactgcatcatcgacaccaccggcttctagcccgggaacgcccgagggcggcacccccgtgggggtgccgccctcgttcgagaacagccgatctaccggtggccggagccaggggtggatcagaagtccatgtcaccacccggcatgccgccgcccgcgggggcaccggccttctcgggcttgtcggcgatgacggcctcggtggtgaggaacagcgcggcgatcgacgcggcgttctgcagcgcggagcgcgtgaccttcgccgggtcgatgatgccctcggcgatcatgtcgacgtactcgccggtcgcggcgttcaggccgtgaccgatcggaaggttgcgcaccttctcgacgacgacgccaccctcgagaccaccgttgacggcgatctgcttgagcggggcctccagcgcgagcttcacggcgttggcgccggtcgcctcgtcaccctcgagctccagcttctcgaagaccgcggaggcctgcagcagggccacgccaccaccggcgacgatgccctcctcgacggccgccttcgcgttgcgaacggcgtcctcgatgcggtgcttgcgctccttgagctcgacctcggtcgcggcaccggccttgatgacggccacgccgccggccagcttcgcgaggcgctcctggagcttctcgcggtcgtagtccgagtcggagttctcgatctcggcgcggatctggttcacgcgaccggcgacctggtcgctctcgccggcaccgtcgacgatggtggtctcgtccttggtgatgacgaccttgcgggcgcggccgagcaggtcgagaccggcgttctccagcttgaggccgacctcctcggagatgaccgtgccgcccgtgaggatggcgatgtcaccgagcatggccttgcggcggtcgccgaagcccggggccttgacggcgacggacttgaaggtgccgcggatcttgttgacgacgagggtggagagcgcctcgccctcgacgtcctcggcgatgatcagcagcggcttgccggactgcatgaccttctccaggagcggcagcaggtccttgaccgagccgatcttggagttgacgatcaggatgtacgggtcgtcgagggacgactccatgcgctccatgtcggtggcgaagtacgccgagatgtagcccttgtcgaagcgcataccctcggtgagctccagctccagaccgaaggtctgggactcctcgacggtgatgacgccttccttgccgaccttgtccatggcctcggcgatgagctcgccgatctgggtgtcggcggcggagatggaggccgtcgaagcgatctgctccttggtctcgacatccttggcctgcgccagcagggcggcggagacggcctcgacggccttctcgataccgcgcttgagggccatcgggttcgcacccgcggccacgttgcgcagaccctcgcggacgagcgcctgggcgagaacggtggcggtggtcgtaccgtcgccggcgacgtcgtccgtcttcttggcgacttccttgaccagctcggcgccgatcttctcgtacgggtcctcgagctcgatctccttggcgatggagacaccatcgttggtgatcgtgggggcgccccacttcttctcaaggacgacgttgcgacccttggggccaagggtgaccttgacggcgtcggcgagctggttcatcccacgctcgaggccgcggcgggcctcctcgtcgaacgcaatgatcttggccatctgaagtggtcctcccggacagcggtggattactccggaccgcgcccgcgcccgcgacggacggcctgcgtgcccggcggttccttcccaccggaccctgcgggcctcaccgacccggtcctcgtttcagtagcactctcacatggagagtgctaacgccaatgattagcactcgccccccgagagtgcaagcggcttcggggaacgccccgccactaccgggcgtacgcacgaggggcccccatcccgtgtccaggatgtgggcccctcgtggtgttccaggtcttcgacgaagactgatgcgtcggtggtcgatcgcgccaggactagccgagtgcgagcttgaccatgtccgcctgcggacccttctggccctgcgagatctcgaactcgacccgctgaccctcttcaagggtgcggtacccgtccatctggatggcgctgtagtggacgaacacatccgcaccaccgtcgaccgcgatgaagccgtagcccttctccgcgttgaaccacttgacggtgccctgagccatgcctaactcccctattactggcccttgcgcaggaacgcacttcacgatcccgggtcagaacttgcgtcggaacgcgtcgaccgaggctgaatgtatctgcgcggatgctgtctgcaacaggtcaatccgatgagaattctggacaccgagaaacattgaaatagagtgaaaatttgccatactcccgggcaagtcgggcctgacatatctcgccaaagccccataccgcactcgcatgttggcccgatgtcgacccttgcgcggcccgttcatatgcagggggcaagaacagcggaggggacttccccaaccctaccgtgcccaatcaagcagaattgccccctccgcttttagcggagggggcaatttcggttttcgcgtgtcagcagccgccggcgacggccggaatgatcgagacaccggcgccgtccggcgtcgccgcctgcagcccgccctcgaaacgcacgtcgtcgtcgttcacgtagacgttcacgaagcggcgcagcttgccctggtcgtccaggacgcgcgcggcgatgcccgggtggctcttctccagggactcgatgacctcggcgagggtcgcgccctcggccgggacctcggcgacgccgccggtgtaggtgcgcaggatggtggggatgcggacgttgacgctcatggcgctactgcctttccggtagggcggaggagaaggggtcaggccaggccggcggcgcggaacgcgtccaggctcgggcggatggtggcggtctgcccgctgtcagcggccaccgcctccagggtcttgaggccgtcaccggtgttgaggacgacggtggtcagcgtcgggtcgagctgcccgttgtcgatgagcttcttcgtcacgccgacggtcacgccgcccgcggtctcggcgaagatgccctcggtctgcgcgaggatcttgatggcctcgacgacctgctcgtcggtgacgtcctcgacgaaaccgccggtgcggcgggcgatgtccaggacgtacgggccgtccgccgggttgccgatggccagcgacttggcgatggtgttcggcttctgcgggcggaccacgtcgtgaccggccttgaaggcggtcgacaccggggagcagccctcggcctgggccccgaagatcttgtagggcttgtcctcgacgaggccgagcttgatgagctcctgcagacccttgtcgatcttcgtcagctgcgagccggacgcgatcgggatgacgatctggtcgggcagctgccagccgagctgctcgcagatctcgtacgcgagcgtcttggagccctcgccgtagtacgggcgcaggttgacgttgacgaagccccagccctcgcccagcgggtcgccgatgagctcggagcagaagcggttgacgtcgtcgtagttgccctcgatgccgacgagttcgccgccgtacacaccggccatgacgaccttgccctgctccaggtcgtgcgggatgaacacgcaggagcggaagccggcccgggcggccgcggcgccgacggcgccggccaggttgccggtcgaggagcaggacagggtggtgaagccgaaggcgcgggcggcctcgacggcgatggccacgacgcggtccttgaaggagtgcgtcgggttgccggagtcgtccttgacgtagagcttgccggtgatgcccagctccttggccaggttggccgcgtccacgagcttggtgaagccggggttcaggctgggcttcgacgccacgtcggccgggacgggcaggagcggcgcgtagcgccagatgttgttcgggccggcctcgatcgcggcgcgcagggcctcggggtcaccggtcgggaggtcgtaggcgacttccagcggtccgaagcactcggcacacgcgaagatggggccgagttcgaagcgggtgccgcactcacgacaggaaaggccgttggcgggtccgagatcaacagaggtggcgacagtctgtgcagccatgatggcgaggccctttctcctcatcttccccatggcgcatttcgccatgagacggaattggcaccttccctagccggggacctcgctgacgacgctggtgcgcgatcgcgagaaccgactggagggttgccggggcttcaacgggccgtgtccctctgcccctctggatgagcggtatggcaccggcatacgcgctctgtggcgcgccggtgcgtttgtacgcgggggacccccggcatgcggtggtccttcgcgttgttcaagactgtaaccgaaggcccgggcggttgagacagccgtccgaaccgcgagatggatcacataagggcgtatatcgccgacacgcagggagtgctgagggtgctggaagaggtggagcgatggctggccgaccgctcctggtccgccgccgaccgaccgctcgaccagctgctcgaccggaaacgggcggccgggaccacggtcagcgtcgtgctgcccgcgctggacgaggaggccacggtcggcgcgatcgtcgaggtcatccggcgtgagctgatcgagggactgccggtccccctggtcgacgaactggtcgtgatcgactcgggttccgccgaccgcaccgcggaggtcgcggcgaaggccggggcccgggtggtgcaccgtgacgagatcctcccgaggatcccggcgctgcccggcaagggcgaggtgctgtggcgctcgctcctggccacgggcggggacatcgtctgcttcgtcgacgccgacctgcgggacttctccgccgccttcgtctccgggatcgtcggaccgctgctgaccgaccccgacgtgcagttcgtcaaggcgatgtacgaccgcccgctgggcgacgcccccggccagggcggccgggtcaccgagctggtcgcccggccgctcctcaacctccactggccgcaactggccggcttcgtccagccgctgggcggcgagtacgccgtacggcgctccctgctggaacggctgccgttccccgtcgggtacggcgtcgagctgggcctgctggtcgacgcgctgcacacggtcgggctggacgcgctggcccaggtggacgtgggcgtacgggtccaccgccatcaggacgggcaggcgctgggccggatggccgcggcgatctaccgcaccgcccaggtacggctctcgcgcgggcacctcgtacggccggagctcacgcagttcgagcgcggcccggagggcttcgtaccgcggacgtacccggtggacaccgaggagcggccgccgatggcgggcatcaaggagtacgcgctgcgtcgcgtggcgtgaccgcgtccatacgtttgagcgagagcgggccgggctaggttggccgcatggcttcccaggtactcgtagcagcgaaccgcggccccctctcctacgccctcgacgacggcgggacgctcagcgcccggcgcggcgggggcggtctcgtctccggactctccgcggccctcgcggagcaaccgggggccctgtggatctgtgcggcgctgtcggacgcggaccgggaggcggtccgccggggcgtcgccgaaccgggcgtccgcatgctggacatcgatcccaccgtgtacgacgacgcgtacaacgggatcgccaactctgtgctgtggttcacgcaccaccacctgtacgacgtcccgcgcgagccggtcttcgacgcgcggttccggcggcggtgggagtcgtacgtggcgtacaaccgggcgttcgcgcaggccctggccgaggaggcggcggacggcgcccgcgtgctggtgcaggactaccacctggcgctggtcccggggcagctccgggaactgcggccggacctgcggatcgcgcacttcacgcacaccccgtgggcctcgcaggagttcctgcggatgctgcccgacgacatccgcggcgaactgatgtgggggatgctcggcgcggacgtggtcggcttccacacctgggcctgggcgcacaccttcatgggcggcgcgcacctgaacgacgagcgcggtatcgccgagccccggttcgcggcgggggtggaggcgtcgggggcgaggtacgtccagaagagcccgtcgggtgcggtgcggcacaagcggaccgaggtggccgtgtacccgctgggcgtggacgccgacgagctgcgggcgctcgcccaccggccggaggtggacgccaagctggcgcagctcagggcggagaccggtggcctgaagaccatcgtccgggtggaccggacggagctgtcgaagaacatcctgcgcggcctgctggcctaccgggaactgctgacggtccaccccgaatggcgcggccgggtcgtgcacctggcctcggcgtacccgtcgcggcaggacctgaaggtgtaccgggactacacggcgtccgtcgcggagctggcggcgcagatcaacgcggagttcggcacggaggactggcagccggtgctggtgtcggtgaaggacgacttcgcgcggtcgctggcggcctaccggctggcggacgtggcgctggtgaatccggtgcgggacgggatgaacctggtggcgaaggagatcccggtggtgtcggaggcggggtgcgtgctggtgctgtccaccggggcgggggcgtacgaggaactccggcaggacgcgctgacggtgaacccgtacgacgtgtcggcgacggcggaggccctgcacgctgcgctgaccatgccggtgggtgagcgtgcggaacgcacgaagcggctggccgccgcggcgacggccctccccccggcccagtggttcacggcccagctctcggacctcggcccatccagccccgccggcgtgtgaggcgcgggggtccgggggccggcccccggcagcggcgccgctgccggggctccgccccggaccccgctcctcacacgccggagaggctgaaatgtgcaggcggctgagagcgtcagcgtcagccgcggatggccccggccagggtggccaggaaggcggcgaccttgcccggtccgggcaggaccaggtcggcccgtgcggcgagctccgggacctcggccgagccgctgcacaccagcagccccggcaggccgtccttacggcccttctccacggccgcgaaggccgccaggtcacccaggtcgtcgcccgcgtacagcaccgcctccgcgtcccgctccgccaggaactcggtcagggcgacgcccttgtccatgccgggcggcctcagctccagcaccgcccgccccggctcgaccatcagcccgtgccgcgccgcgagctccgccagcggctcccgcagcgcagcgaaggccgccgccgggtcctcggcccgccgggtgtgcacggccagcgcccggcccttctcctcgatccaggtgccgcgccaggccccgatggagtccaggaaccccggcagctcggcccggacggccgccaccccggggtgctcggcgggcgcgtggacgatgccgctgacggcgtcccaccgttcggccccgtagtggccgaggacgaccaggtgctggagtccggggaccccggcgaagcccccgtagcggacggcgacgcccgccggccgtccggtgatcaccgcgaccgagtcgacctcgggggcgagtgcggacagggccgggacggctccggggtgggctcgggcctggtccgggtccgggacgatgtcggcgagggtgccgtcgaagtccagggcgaccacggaccggcggggtgcgcggagcagggcttcgagtccctcgcgtccggctgcggtgacgggcatcggcaggtcgtgcggatggctccccatatgcacgaccctaacggcccaacggtgtgacggctacggctatcgccgggcccgctgggcctcgcggatcctgcgcagccggttcaccgtgcccggggcgtgcgccagggccctcggatcgtccatgagcgcgttgagcagctggtagtagcggacgggggtcatgcccagcccctcccggatggcccgttccttggctccgggccctggccaggtgcgtccctcgtacgcgagcaccgcggcctccgtggccgtcagctgcccctcgtccgtcataccgccagattaacgccgcgctctgacacccggcccgccgccaccgctcagcgcgggtccgccgcgcgggcggtggtggcgatcccctccagtaccttcgccggctgtccgcccggctggacggtcttgccgatgttctgcttgatgtcctcgctgacgcccgcccaggacttcttgccgaccgggtacagccgcgagccgggcagcgccgtcaggaacggcttcagctgcggggcgttgccgccggtcgcggcctgcttggcctggtagccggtggtggtggcgggcagcaggtcgtacttctcggtgaaggccgtcacgttcttcggctggtacatgaagtcgaggaacttgccggactgctggcggtggccggtcttgaaggccatgacccagtcggcgacacccatcgcgggcttgtcgctgccgtcggcggtgggcagcggcaccatgccgaacttcacgcccttggcctccgcctgcttgagcagtgtcgggtgcccgttgagcatgcctacctcgcccttggtgaaggcgtcgaaggcggcctggcggtccagcttgccgggctccacggggccggtcagcccctggccgaccatcttgtcccgcaggaactccagcgtcttgatgttgggggcggagtcgatcgagtacgactcctcgttgttggtgtatccgccgccgcccgcgagcatccacatcatcgtctcggcctgcgcctcctcgcggcccagcggcagcgcgaagggggtggggacgttggcggccttgagcttcttggcggcggcttcgaggtccgcccagctcttcggctgccagcccttgccgtccttgccgatcacaccggcgtcggcgagcagcttctcgttgtagaagagcagccgggtgctggccacgaagggcatgccgtactggatctgcttgaccttgccggcgtccgcgagcgggccgaggaagtcggcctcggtcttcacggagagcagctcttcggccgagtacagcttgtcggcggccgcgtagtcggagtaggcgccgatctgggctatgtcgggggccttgccggccttgaccatctcggcgaccttggcgtcgacctcggaccaggagtagacgctgacctcgaccttgatgcccgggttggccttctcgaagcctgcggcgaggtccttccagtaggactcggaggagttctgcggattgtccccgtagtcggccgccacgacccgcagggtcacctcgttgtctccggtgagcccgccgagggctccgcagcccgtcagcgtcacggcagtcaggcacagcacggcgccggacgcggccaggctcaggtaacggcccttcacagttctccatccactcttcttgtacgtacgatccacgtaaggtctacaccactttggcggctcgtccacatcgggctcccgcccggggtcccggatttgtatggccgctcaacaatctccctcattggactagacctttccccgccgagcacgcgagactgtctctgtgaaatccgtgaaacacgtcatcgccctcgatgtgggcggcaccgggatgaaggccgccctcgtcgcggacgacggcaccctgctccacgaagcgcgccgggccaccggccgcgagcggggccccgacgccgtcgtcgagacgatccaggacttcgccgccgagctgctcgacaccggccgggaacgcttcggacggcccgcctcggcggccggcgtcgccgtcccgggcatcgtcgacgccgagcacgggatcgccgtctacgcggcgaacctgggctggcgcgacgtaccgatgcgcgccctgctcagcagccgcctcggcggcatcccggtggccctcggccacgacgtgcgcacgggcggactcgccgaaggccgcatcggcgccggccggggcgccgaccgcttcctcttcgtcccgctcggcaccggcatcgccggggccatcggcatcgccggccgcatcgaggccggcgcccacggctacgcgggcgagatcgggcacatcgtggtacgcccgggcggccccgcctgcggctgcggccagcacggctgcctggagaccctcgcctccgcctcggccgtcagccgcgcctgggcggccgcctccggcgaccccgaggccgacgccgcggactgcgccaaggccgtcgcctccggtgacgcgcgcgcccgggaggtgtggctggccgccgtcggcgccctcgccgacggactggtcaccgccatcaccctgctggacccgcggacgctgatcatcggtggcgggctcgcggaggccggggaaaccttgttcacaccactacggacggccgtggaggagcgcgtgacgttccagcggctcccccacatcgttccggcggccctcggggacaccgccggatgcctgggcgcagggctgctcgcctgggacctactcgccacggaggtacctgcctgatgtccggaagcgcgcacagcactgttctttcgggcgccagggtggtgctgcccaccggaacggtggcgaacggcagggtcatcgtcgacggcgaccgcatcgccggcagtgcccacgagggcgcgcggaccgtcgacctgtccgggcactggatcgtccccggcttcgtcgacacgcacaaccacggcggcggcggcgcctcgttcacctccggcaccgccgaggacgtcctcaagggcgtccgcacccaccgcgagcacggcaccaccaccctggtcgcctccaccgtcaccggggacctggacgaactggcccgccgcgccgccctgctcgccgaactgacccagcagggcgagatcgccggcatccacttcgaggggccgttcatcaacccctgccgcaagggcgcccacaaggaggacctgctccgcgaccccgacccggccgaggtccgcaagctcatcgacgccgcgcacggcgccgcccgcatgttcaccctcgccaccgaactccccggcggcctggactccgtacggctgctggccgagcacggggtgatcgcggcgatcggccacacggacgccacgtacgagcagacgcgggccgccatcgacgcgggcgcgaccgtggccacccacctcttcaacgcgatgccgcccctcgcccaccgcgaacccggcccgatcgccgcgctgctggaggacgagcggatcaccgtcgagctcatcaacgacggcacccacctgcacccggcggccctggaactggccttccaccacgcgggcgcgcaccgcgtcgcgctgatcaccgacgcgatggacgcggccggcttcggcgacgggacctaccacctcggcccgctggaggtggaggtcaggcacggcgtggcacggctggtggagggcggctccatcgccggctcgaccctgaccctggacaccgccttcaagcgttcggtgaccctcgacaaactgcccgtggagtccgtggtccaggcgatctccgccaacccggccaagctgatcggcctctacgacgagatcggctcgctggagcccggcaagtacgccgacctcgtcgtgctggacgccgcgttcgaactcaagggcgtcatgcggcgcggcgaatggatcgtcaacccgccctcctgaccgccgatctgacggccgagcggccgcggacagggaaaacggtcggccccggcactgggccgaccgccctgcgtttggcatgatcccggcagcatcggacccgggagtgcccatgatccttaccgtgacgctcaacaccgcgctcgacgtcacgtaccaagtgccgcggctgcttccgcacgcctcgcaccgggtctcggccgtcactgaacgcgccggcggcaaggggatcaacgtcgcgcgcgtcctggccgccctcggccacgaggtcaccgccaccggcttcgcgggcggaccggtcggctccgtcgtccgggggctgctcgcgcggtccccgggcgtggtcgacgccctggtgccctgcgccggcaccacccgccgcacggtcgccgtggccgacgcgggcaccggcgacaccacccagttcaacgagccgggcccgctgatcaccgccgcggagtggtcacggttcctcacgcgctacgaggacctcgtgtccggggcccgcgccgtcgccctgtgcggcagcctcccgccgggcgtgcccgtgggcgcgtacgcgctgctcgtccggtcggcccgcgcggccggggtgcccgtcctgctggacaccagcggcgaggccctgcgccgcggggtcgccgcccgcccggagatcatcaagccgaacgccgccgaactggccgagctcaccggatcccgcgacccgctccccgccacccgcgacgcccgccgccggggcgcccacgcggtggtcacctcgctcggcccggccggcctgctggccgccaccgccgagggctgctggcaggcgtccccgccccgcccgctgtccggcaaccccaccggagccggcgactccgcggtcgccggcctgctgtccgcgctggccgagggcctggactggccggaccgcctcacccgcgcggtcgccctctcggcggccacggtcctcgccccggtggcgggggagttcgaccccggcgtctacgaggagctgcggggcgccgtacgcgtcaccgccactgtcgcgagcggaggttgaacacaagagaaatgatggtccgtcaacatgcggtgaagctcacgctcttgacgggccgacgcgtccatgagcggggatgggggccacctaagatcaaaaagcacaaatgatcttcaaggcaacgaggctgtccaagtgaaccgattcttccgcaacctgctcaccgtcaccaccggcctggtcgccgtctccgcgctggccgcggtccccgctcaggcccagacgatcaacggcggctcttgcggcgccgggtaccgccagcaggacgcctacccgctcggcgacaaccagggcgtctccggcgccggcgtggtcttcctgtactacaacagctccaacggcacgaactgcgcgatcctgcgccgcgactcccggttcaaggtcaccgacggcatgggcgtctcgctgaaggacaacgccggcaacggcgtcgccgacgggcagcgcgcctacacccagttcgcgggccccgtctacctcaaggcgccgggccggtgcgtccaggtctggggccagctcacgggcatctggctgacggagaactccagctacctggagaaggagcacgacggtggcagcggctgggtccactgcggctagaagtccgatgtgaacacgcgagtccggctcccccgcgcatgcgggggagccggactcgttcagggcgtcggtcgagtgacggaccgggtgaaactcccgcaggtcagaagttctccagccacagctggtcgatgttgacgttgcagctgttgccggtctcgcacgacagcttgatcgtgttggtgcccttttcgaggttcacctggccccaggtcgtctgccagcccttctcccagtcacccttgggcgacttggcgaagttgcgcatgctgatcggcgcctcgttcggcttgccgttgacggtcagggtgccgttggcgtcctcacccgggatgccgaagcgcacgtagaacctgtacttaccggccttggggacctccagggtccaggtcacggccgcgccgggccggttgaacccgccgacgtactggccgcccgagctcttcgcccccggaaccgtggactccagagccgcaccgcccgtgatggacatgcccgcaccggccgcctcgcccttcggcagcgggtcctgcgagggcttcgggctgctcggggccgggctggccgggttctggggggccggcgactgctggccggcgttcgtggtcggcccttccttgcccttgtccttgtcaccgaactgcagggccgcggcgatgccgatcacgaccaccgcgaccacggcgacggccgcgatcagcagaccgcgccggctggacccgccgccgcctcggccgccgccgtgaccgccggggtgcgcaaccgcctgggtctggtgctgcggggactgcgcctgctgcgccggaacgccgtagccgcccgcctggagcgcttcgggggcctggtactgggcctggtagcccgggccctgctgctgcgggacggggccgcgctggccgccgttcctgcggtcaccgaccgtacgcacctggtggtgcgaggtgcgggggacgccgggctgaggaccaggctgaccgccgcccgccgaaccggggtagccgtatccgccctgcccgggcggggtggccccggcggcctggccgtcctcgtagaggtagccgaacggatcgtcgtcctcgggcttgttcgccccaccgtgcgggccgttgttcgcgggcgtcgtcatcgcaggtcactcctttcgacccccgggagcctaccccgaacacgtgcgcccacgagcggcagaccgcttcatcccgcccggcgatgggccttcgaccgggacctcttctcgatgtacatccgctgatcggcggagcgcagcacctcgtcggcggacatcccgcagctggcccaaccgatgccgaaactggcccccacccgcaccgcacggccgtccacccggatcggcgggatgatcgcgttgcgcagccggacggcgaggtcggcggcgtcggcggcgcccaggccgtcggccaggacgacgaattcgtcaccacccagccgggcgacggtgtcaccgtccctgacgccggtcgtcagccgccgggccacctcgatcaggaccgcgtcgccggtgtggtgcccgaaccgatcgttgatcgacttgaagccgtccaggtcgcagaagaggaccgcgagccccttcgtcccgtcgtcgatgtcggtcgcgggagccaccgtgtgcacgtggtggtcgtacggaccgtccgccggggcgggcggcgccccggggaattcgaaggggtcgcccccggggaaccggtcggagccgtcgccgtgaaacccgtgctcaccggcaccacccgcctccgcccccaccgggtgcccgtcgtgcgccgcgtgcgcggcgtggcccccgtgcgccgcgtgaccgtcgtacgtgtcgcgcccctcgaaggccgcgtccagcgcctccaccgcgctggcccgcaccgactgtggcctgcggcacagccgggcgccgaggcgggcccgcagctcggcgctgttgggcaggccggtcagcgagtcgtggctggcgcggtgggcgagctggagctcgtgccgcttgcgctcctcgatgtcctcgacgtgcgtgagcaggaaccgggggccgtcggcggcgtcggcgacgacggagttgcgcagcgagacccatacatacgtgccgtcgcggcggcccaggcgcagctcggcgcggccgccctcggcggaggtgcgcagcagggtgccgatgtccgcggggtggaccaggtcggagaaggagtagcggcgcaggacggaggcgggccggccgagcagccggcacagcgcgtcgttggtccgcagcagccggccgtgctggtcgccgcccatctcggcgatggccatgccgctgggcgcgtactcgaaggcctggcggaacgactcttcactggcccgcagtgcctgctgctcgcgttccagccggacgagggcccgctgcatgttcgcgcggagccgcgcattgctgatggcaatcgccgcctggaaggcgtacatctggagcgcttcgcggccccaggcgccgggcctgcggccgttgcgcggtctgtccaccgaaatgacacccagaagttccccgccggacgcatacatgggtgcgtagagccggtcctcggggtgccactcgtcctcgaaccggggatcggggccgtcggtgtgccactgggggacgtcgtcctccatgaggacccagccctcggtgtgcgggatgaacctgagcccgtcccagttctcacccatcgtcaggcggcgttcccaggaggcgcgggagccgacgcggccggtgatgagggcctccgcggcggggtctcccgcgaaggcggcgacgacgagatcaccgtccgggcgaacgaggttgacacaggcgagttcgtagccgaggcccacgacgatgccgtccacgacggtctgcagagtgtccgccaggctccgggccgtattgagctcggccaccacccggtgcagctgccgcagggtcgcaagacggacgtacggctccgactcggtctccattgctcgctctccccgagacctcgacagcaactccaggtttgtcatcggcgtttcgttgcggtgtcccgtccactgaatcacagtgagctgtgcggcaggtacacagggtcaacaaatcttgccctctgtgactcaagtcacatcaggtgaatatcggtgcgcggtgggctcgtgcacgactgggagcgctccctcacattcccgagagcaaacgatacgcccgggcctaggccaaggggcggggacgcgactcggaccagggcccgatgcgcggcgcggaagggcgagattagcgtttcagcgtgctgaagacgacccccgtacccaccgtgtcccgcggaaccccccatgctgagggagtgagcaatgacgagttccgggccgcgatgtcccggctggcggcgggcgtgtgcctgatcaccgcgcacgagcccccgctgaccgcggacggcccgcgcggagaggacgtcggcatgacggcgaccgccttcatgtccgtgtccctggatccgccgctggtcctggtgagcctgcgcgagggctcccggatggacgacctgctggcggaacagcccctgtgggcggtgtcggtcctcgccgaccaccagctccaggtggcgggccgcttcgcgatgaagggccgcatcagcgaccggctgctcttcgccgacctgccgcacgtacgcggcgaggcctccggcgcccccctgctgagcggcgccctggccaccctggaatgccgtacggagaaccgcgtcgaggcgggcgaccacaccctggtcgtcggccgggtcctgacggccggcctgccgtccccggacggtcagcccctcacgtacttccgcgggcgctaccggcacctgggcacgtaaggcgggcagagcggacagggccggcagagcggacacggcgggcagagcggattgggcgagcggggcgcgtaaggcgggcaagggcgcggctaccagtcccggccggtgcggccgcgcttggtctcggcccgcgccttcttctcccgcagccggcgctcattgatcccgcgcgggatcttcgtcgcccggcgctgcttcggcggcggcgccgtcgcctcggccagcagcgaggccagccggaccagcgccatctcccggttgcgcagctgcgagcggtgctcggaggcccgtacggtcaccacaccgtccaccagcctcgccgcgagccgctccagcgcccgctccttccacacctcgggcagcgccttggtggccgccaggtcgaacagcagctccgcgcgcgagtccgaggtgttcacgtgctgaccgccgggccccgaggaacgcgagaaccgccaggcgagctctccctcggggagcacgaccgaaccgcggatgacatagggaccaggcatgccccctatgatccgcccccggcccggccgccgtcacccgtatttaccgcccgccgcatccgggcggcggagatccgccgtcacggacaattcacgacgggaacccgaccggcctctcgtcgcgttatagggggcagcggtagtttgaccgcctgtacgtacatgttggatgaggaaagggacattcccatggctgtcagcctgtccaagggcggcaacgtctcgctctcgaaggaggccccgggcctcgccgccgtcacggtcggcctcggctgggacgtccgtacgacgaccggagtcgacttcgacctcgacgcctcggccatcgcggtcaacccgacgggcaaggtcgtctccgacggccacttcgtcttcttcaacaacaagtccaccccggaccagaccatcgtccacaccggtgacaaccgcaccggcgagggcgcgggcgacgacgaggccatcaacgtcaacctcgccggcctgccggccgacgtcgacaagatcgtcttcccggtctccatctacgacgccgaggcccgcagccagaacttcggccaggtccgcaacgcgtacatccgcgtcgtgaaccaggccggcggcgccgagatcgcccgctacgacctctccgaggacgcggccaccgagaccgccatggtcttcggcgagctctaccgcaacggcgccgagtggaagttccgcgcggtcggccaggggtacgcctccggcctcaccggcatcgcgcaggacttcggcgtcaacgtctaggacaccagcgccggcgaagccccctcccggccgtccggggagggggcttcgctaccgttcgacaggtgatcctgcaccccctcgtccccgtcgacggcgccctccccggcccggtcctcaccgagatcgccgcgctctactcgacgaaccacgccttcttcgaactcagcggggacttccccgacccggaccgcatcacggtcgaacaggtcgccgccgcgctcgccggtgaactcgcccacgacagcgccgaggtgctcctcgcccggtccgccggccgcctcgtcgggctggccgccaccctcgctcaggcacccgccgccgacgacccggacccgtggatcggcctgctgctcatcgacgccaccgcccaccgcgagggatacggccgcgccgtggccaccctgatcgaggaccgcttccgcaccgccggacgcgcgggcgtgcgcatcgccgtactggacaacaacccgacggcgctcgccttctggcagtcccagggctacgtcgagctgcgccgggccaaggaccgcgagctgggccgcgactgcaccgtgctgcgcaagccgctcgaagccccgtagcggacacgaggcctactcgggacggtccttcccgtacagccacacgtcccagaccttcttcaggtcgtggcccgtcttcttctcggcgtaggccgtgaagtcggccgtgctcacgttcccgtgccggtggtcggcgacccagccgcgcaccagggcgaagaacttctcgtcgcccacctcctgccggatccggtgcaggaccatcgcgccgcggtagtacaccggctccgccgagatgtccgcgggcccgggcggagcggccggagggaaggcgtaccagtcgctgccggcgtcccggtcgacgtccgtgtcaccggtccggaacgcctcgaagtactcctgcgccgtggacccgccgtggtcctcggcccacagccactccgcgtaggtcgcgaagccctcgttgagccacatgtccttccaggtcttcggggacaccgagtcgccgaaccactggtgggcgagctcgtgcacgacgagctcctcctcggtcggcgcgccggagaagacggggcgtccctgggtctccagcgcgtaggacagggtccccgcgggcaccacgatcgcgcccgccgaggcgaaggggtacggaccgaaccgtccgctgccccactccaccatctccggcagccgggccagcggacccgtgttcgcggcctgctccccgggcgccacggcgctgtagaggccgacccccgagggcgtccgcccggtcgtcaccttgaacggcccgacggcggcggtcgcgagatagctcgccatcggctccggactgtgccacgcgaacgccgtccgcccgtccgcgtcctcggtacgggagcgcaactcgccgttcgagaccgcctcgtagccgcgcgggacggtgatggtgatgtcgtacgcggccttgtcgccggggtggtggttgccggggaaccaggtcatcgaaccgaccggctcgccgacggccaccgcgccgtccgacgtggtgatccagccctccttggcgccgtccacgtccacgaggggcttcggcttcccgctgtagtcgacctccgtacggaagacctcgcccttcgccaggtcctcggcggggcgcaccgtcagctcgttgccggtccggttgtaccgggccccctcgccctggacggtcacgccctcgacgttcaggccgctgaaatccaggttgaaggagctgagcgcctgctcggcgcgggcggtgatgacggccttgccgtgcagccgcccgtcggcggggtcgtagtccaggtccagcgcgtagtggtcgacctggtagccgccgttcccggcccgggggaagtacgggtcccgcagccccgacgcacccggccgcccctgcaccgtgtcccccgtacaccccgtggtgagggcgagcagggcgacggcggagggggcggcgaggcggtagagcgtacggagttccacgcactcgatcctaagcgggccggcgccgcggactacttgccgagcgcgtccacgcccgccttggcgaacttctcgtccaggtcaccgctcggggcaccggccacacccacaccggcgacgggcgcgccgttcgcctggaccggggtgccaccgccgaggaagagggtgccggggatgtccttcaggttcggggtctgggccagccggcccacgagcaccgaggtcggggcgttccaggacacggcggtgaaggccttgcgctgcgccgagtcgtaggactgcgggcccgcgccgtcgccgcgcagcgtgacgatggtgttgccgttgcggtcgacgaccgcgaccgtcaccttctggttctcggactccgcggccttcagggcggcctgggcggcgcgcgtcgcggcatcgacggtgaggtgcgtcgtcgtggtgaagttcttgtcggccggcccgtccttcttcgaggagaccgaggcgacggacgccgaagcggcctcggaggccggggtcgcgctggcgctcacggcaccgaaggctccggcgcccagggcgacggcaagggcggtaccggtgagaacgcgggtgcgggtcttcatctctgctcctgagaacggtggcacggggcggccggtcggaccggctccttcactgctccaagcctcggtccgaaccccccgccaccccgtccccgtaccggctcgccccacccagcgcaccggctgacccccgggtcgtccgatcggtcgatgcgcaccgcctccggcgaggtattggctggtcacgccacgccggctcgctcagccccgccggcgttcgaggcgcggggtacggggtgcggggcggagccccgcaacgacgccgcagccgacaatggacgcatgcccccgaccgaggagcaccccgtgcaccccgccccgccgccgcgcgacgacacccgcacgctgaccaccgtcgcccacaccgcgttcttcctgctcctcggcgcctccgtggtccgcttcctgctgcgccaccccggcgaaccccgcaccccgtggatcatcgccctcagcatcacgctggccctgctctacgtgctcggccccgccctcggcgccgcccccaccgcccggcggctcctgtggctgggcctggtcgtcaccacctgggtgatcctggtcgtcctcgcgccgagcttcgcctggtgcgccgtaccgctgttcttcaccgccctgcgcaccctcccgccccgcgccgccgtcgtcctcgtggccctcctgaccgccttcgtggtgatcgcccagctgcagctgtcgaagtccttcgaccccaacctcctgctcgccccgcccgccgtcgccgcgctcgccaccgccgtcttcgtccacatggaacgccaggcccaggcccagcgcacgctgatcgacgacctgatccgcacgcgccgcgagctcgccgccaccgaacgccgcgagggcaccctcgccgagcggcagcggttgtcgatggagatccacgacaccctcgcccagaacctgtccagccagcagatgctgctccaggccgcggaccgcacctgggacaccgacccgggcaccgcccgcgcgcacgtccgtaccgccaccggcatcgccgcgcacgggctcgccgaggcccgccggctcgtccacgacctggccccgcccgagctcgccgacggcgccggcctccccgaggccctgcgctccctcgacgccggcccggacatcgaggtccgcttccacctcgaaggcacccccgccccgctccccgaccgcgtccagtcggccctgctgcgcatagcccagggcgcactggccaacgtccgcgagcactccggagcccgtacggccgcgctcaccctgagtttcctcggcgaccaggtcgtcctcgacatcgccgacgacggccacggcttcaccgaaccgcgctccggcacccgctccggcaccggcgccgacgggcgcggacacggcctcccggccatgcgggcccgcgtccgccagctgggcggcaccctgacgatcgaatccacgccgggcgagggcaccgtcctctccgcggccatccccctggagccggccccatgaccacgatcctcctctgcgacgaccacgtggtggtccgcgccggactcctggccctgctcggcagcgagcccgacatcgaggtcctcggcgaggcgggcagcggcgaggaggccgtcgcgctcgccgcgaaactccaccccgacgtggtcctgatggacctccagctgggcgagggcatcgacggggtcgaagccacccgccgcatcacggccctcccccggcccccgcacgtcctggtcctcaccacctacgacaccgacgcggacatcacccgggcgatcggcgccggcgccaccggctacctcctcaaggccgaacgcccggaggaactcttcgccgccatccactccgccgcccagggccgcaccaccctgtccgctccggtcgccagccgggtgatggcccacatgcgcggcacccggcccaccctgaccgaccgcgagctggacatcctcggccagctggcccggggcctgggcaaccgcgacatcgcccgcgccctgttcatcagcgaggccacggtcaagacccacctgggccgcatctacgacaagctcggcgtcgacacccgcgcgggcgcggtctcggtggccaaggaacagcgcctgctgccctgacaccggagatgagcggccccggcgcgcgtgacaccatcagctacgtgctcgacatcggctactccctctcccggcgcttccccgaccccccgcagaccgactaccgctccgcggacgtccacaccctgcggcacgacctgttctgcggggacgtgtacctcgccgacaccgccgcggaccgggaagtgtccacagcctggggatgggtgcccgtactggacttcgcctgggcgctgtgcgacatcgtcgaacagctcgacaaggacccccgcggcaaccgctccgccaaccgccagtacgccgagctcgacttcaccgagtccacggaccgcatgctcttcgagcgccgcttcggctgggtcgacgtcgaggccgactggatgccggccgaggaggccccgctgaccttcagccaccgcctgctgcgccgcgaggcccgcgacttcctgcacgacctcctcgcggacctgatcgacatgcacgacggcctcgccgacaacccggccatctggaccctccaggcccgcttcccccgcgtcccggcgtagaccggaggttcggaacggttcagaacggccggcgggggatgtcccgggcgtcgtggccctgtccggtggaaaggaactcccggaacacctgcgtggagcgcgggttctgcccgcactgccacacgccgtgcgggcagtagtcggtgatgctctggtagagcggctggtgctcggcgaaccaggccagcatgccccgcacgtactcgggattgtcgccgtgccggaacagcccccattcggggtacgagatccgcttgccgtgcgccttcgcgaagtcgacctgctgctggagtccgtagggctgggtgacctgctcctcgaaggtccggccgggctcctggtcgtaggagtccatgccgacgacgtcgaccacgtcgtcgccgggatagcagctggtccaggcgatcgcgtccctcccgcggttgggggcgtagtcgaaacggaaccgctggccctccaccgaccgcatggcggtcacgatgcgccgccagtacgtcttccagttctccggatcgggactgcaccggtgggtgtagtcgaagccgttcatctcccagccgagcacgatcaccgtgtccggcaccccgaggtcgaccagacgcctcgccagccgctggaagtggtggtcgttcgcaccttgcgcgccggagcggatcagctcggcgacccggtcgtcggcaacacgggcctcgttgtgctgctgcatgggcacgttcagcacgaacaggcgatcggctttctccttgcgccactgtgcccaggtgctcaggaaatacggttccccctcgatgttcggccaggtgtcgccgggcagataggtgtgcccggcgcgcagctcggtaccgcccagccagcgcgaaagttccgccatccgctcgacgccgggcgagtcgtagtggaggtaggcgcccacggcgacccccgtgacctcggcgccctccgtccccgcgctgcccccggccccttcccgcgacggcggactcccgaagaagccccccacgacgagcaggccgacggcgaccgtactggcgcaggcacctgccaaccagcggctccgacgggacatgccacctccagaggcctcgcgcaccgatgtgtctgcctgcgacgttaggcgcctcacccggcgcatcgcccctccaggcatccggacgctcggccattcgccgcaaccgccccggcaacggcccgcacccgacccacgggcccacctacggaaccacccgcacccccagctgggaagcaagcgccggagccaggtcgaacagctgcgccgggctgatcaccgccccggccagcgcctccaccccccgcgcgatctccagcacggacgcctcccgcagatccacatcagtcatccgcaccccgccgaagtccaccccccgcagcgcgcagtcccggaactccacccgctccagcaccgcccccgcgaagtccggctccaccagcacgcatccctcgaagaccacgtccttgagccgcgccttccgcagattcaggtagtcgatcttgcccccgcggaccaccacccgctccagcaccgccccgtgcagctgcaccccgcccagccgcgcgtccaccacctccacgtcccgcagcgaagcccccgacaggtccgtccccacgccccggaccccctccagcaccgaatccaggacccgcgccttcgccagccccgcctcgtccagcgcacaccgccgcagcgcgcagtccatgaaccgggccccgatcccctcctgccccgccaggtcgagatccgcgaactccaccccgtcgtagtccccgtccggctccagcccgcccccctcccacaccgtcagctccggcagcctcagctccggccgccgcgccgccctgaccgtccgctcctgctgccctttgcgcgccatgcccccatcgtggaccaccccactgacagaggccgctcttgacctcaaccccgcctgaggtcgcagcctggcgccatgaccaccatgcgagccatccgcctgcacgccttcggccccgccgagaacctctcctacgagcacgcggacgcccccgtccccgcccccggccaggtccgcatcgccgtcgccgccgccggcgtccacctcctcgacaccagcctccgccagggcatccaaggcccgcccgccccgctccccgagctccccaccatccccggccgcgaggtcgccggcaccgtggacgcgctcggccccggcaccgaccccgcatggctcgaccgcaccgtcgtcgtccacctcggcttcgcccccggcggctacgcccagtacgccgtcgccgacgccgaccgactgcaccccgtaccgcccggcctcgaccccgcccaggccgtcgccatgatcggcaccggccgcaccaccctcgggatcctgcagttcgccgacctcggcccggactccgtcgccctgatccccgccgccgccgggggcatcggcaccctgctggtccagtacgcggtcaacgccggcgccaccgtcatcgccctggccggcggccccgccaaaaccgcccgggcctccgccaacggcgcccacctcgccctcgactacaccgaccccggctgggccgacgccgtccgcgcccgccaccccgacggcgcaaccgtcctcttcgactccgtcggcggcgcaaccgcccgcaccgccctcggcctcctcgcccccggcgcccggcacctcgtcttcggctggtccggcggccccctccacctcaccgacgccgaacgcgccgacctcgacgcccgcgccatcaccacccggagcgtcctcggccccgccatgctccagcgggtcggcgcccccgaccccctgcgcgtcctggaaacccgcgccctcgccgaggccgccgcgggccgcctgcgccccgccctgacccgctaccccctcgccgaggccgccaccgcccaccacgacctggaaacccgcgccacgaccggcaaggtcgtcctggaaccctgagcgcctagggggccccgaacgcggccagcgctccgtccgtcagccggtacaccgaccactcctcctgcggccgggcgccgagcgcctcgtagaaggcgatcgtgggcgcgttccacttcagcaccgaccactccagccgctcgtagccccgctccacacacgtccgcgccaactcccgcagcagcgccttgccgtggccgccgccgcgcacgccgggccgtacgtacaggtcctccaggtagatcccgtgcaccccgcgccacgtcgagaaggacaggaaccacagcgcgaaaccgacgacctccccgccctccgtctccgcgatgtgcgcgaacaccgccgggctcgccccgaacagcgcctcccgcagctgctcctcggtggcccgcgcctcgtgcggcaccttctcgtactccgcgagctcgcggatcatcgcgtggatggcggggacgtcgctgacttcagcactacggatcattaccgcagcctagaacgggggtgcagcacctcgacgaccgccaactgctcctcgtccagccgctcctccccgtcctccacgtcccacaggcagttctggagcacccgccccaacgtccacgcccgtgcgcgctcccggtccagcccgaccgcctccgtcagcaggtcgaaccgccaccgcacgtcctcggcccggaagttgcccatgaccgccggcagcaactcgaaacccggatcgcccgccagcggcttcgggtcgatcgccagccacggctcccggccgcccgccagcacgttgccgtagtgcaggtcccagtgcagcagccggtccgccgcagcccccactgctccagaaagcgtgccgcccgcccgggcagtgcggcgatgaactcccgccccgcgtccccgttgtacctgacctgcgcctcgaccaacccgtccggaacctcgaccatcccccgacggtaccggtcccctgcggggtgctcggcggtgcgcggtacggccttcctgtgccgcggggtcgcgcctcaagcgccggcggggccgtgcccctgcggggttgctcggcggtgtgcggtacggccttcccgcgccgcggggtgcgcctcaaacgccggcggggctgggtggtgtggggcggggcttcgacggatgccgcggcggggtggggggacgtggcggggtgtccccgcaggacgagcgcgcaaccaccccgcacagccgagacatgcccgcaggcgcgagccgaggagacaccccggcgcggcaccccgccccgccccatgccgacaggcccgcgcgcccccggccgggacgacccgcacaccgccgagcacccccgcaggggcaccgcacagcgcctagccgcccgccccgaaccgcgacaccccgtccctggacacccttccggaacgaggtgtaccaaatcccccatgacgatcaacggcggtatttccttctggtacgcgtccgagcgaagccgcacccccgcgcccccaccccgcgcacccctcaccgccgacaccaccgccgacgtcgtcatcgtcggcggcggttacaccggcctgtggacggcctattacctcaagcgcgccgcccccgacctccgcatcaccgtcctggagcagaagttctgcggctacggcgcctccggccgcaacggcggctggctctacaacggcatcgccggccgcgaccgctacgccgccctccacggccaccaggccgccctccgcctccagcaggccatgaacgagaccgtcaccgaggtcatcgacgtcgccgccaaggaaggcatcgacgccgacatccaccgcggcggcgtcctcgaagtcgcccgcacccccgcccaactcggccgtctgaaggccttccacgcccacgaggtcgccttcggcgagaccgaccgcgagctcctcgacgcccccgccacccgcgcccgcatcgacatcgccgatgccgtgggctccagctggagcccccacggcgcccgcatccaccccctgaagctggtcaggggcctggccgccgccgtcgaggccctcggggtggtcatccacgagtccacgcccgtcaccgagatcgccccgcgccgggccgtcaccccgtacggcgtggtccgcgcgccctacgtactgcgctgcaccgaggggttcaccgccgccctcaagggccagaagcgctcgtggctcccgatgaactcctcgatgatcgtgacggccccgctccccgccgagacctggtcccggctgggctggtcggacagcacgctcctgggcgacatggcccacgcgtacatgtacgcccagcgcaccgccgacgaccgcatcgcgatcggcggccggggggtcccgtaccgcttcggctcgcgcaccgaccacgacggccgcacccagccggccaccgtctccgcgctgaccgacctcctgaccgccttcttcccgcagctcgcgggtacggagatcacgcacgcctggtcgggcgtgctcggcgtgccccgtgactggtgcgccaccgtcaccctggaccgcgcctcgggcctgggctgggcgggcggctacgtgggctcgggcgtcgccacctccaacctcgcggcccgcaccctgcgcgacctcgtcctcggcgaagccaccgagctgaccggcctcccctgggtcggccaccgcgtccgccggtgggagccggagcccttccgctggctcggcgtgcaggccctctacgccgcctaccgcgaggcggaccgccacgagagctccacccaccgcccgacgaccacccccctggcccgcctggccgaccgcatctcgggccgccactgatcagacggccgaggtcaggccctcgatcgccgtccgggcccattcctgggcccccaccgccgtcccggccaccacgccggtcgcgaccggtgccagggctcccttgagcgcggccagggcccggcgcagccgtccccggtcgggttcgccgtccccggcgacctccgccaggacgtcctgggcggcggcctcggcgtcctcgcggtcccggtcgggcaggcccgcgccggggagctgccgcagcaggtcggcgacgagggcggcgagggcctcggagccgggcgcgggcgcggtgttgtgctgctggttctgggtggccgtgtcgttgccccaggcgaactgggctccggagacggggccgtggaagaccggaccggaccggtcgtcgccctgcggtcgatcgctcatgtgcgggtaccgtcctcgttcgtcgtccggtgctggacggcatggatgttccgccacgccagctggacgtcgcggaccgggccgttgaacaccggtccctcgtagtggtggtggatcacggtggggcccggttcggtcctgacggccttttcgagcacgggcagcggcgtgcgcagcccggtcaggtcgacgagcccgttgtggaggatgcccagttgccccgtccccgtcacggagcagtcctggagccggcctccggagtcgtcgacgaaacccgcgccgcccaccgcgcagtcgacgagggtggcgccctcgatctccagccgggccgtgtcccgcgcgaagacgcccagtccgtcgctgccggtcacggtgaggttccgcgcgacgacccgggcactgccgaaggcggacaccccgccggtggtcaccgccgcggccccgcagtcgtgcgcgagcagctgggcctcttccccggcgccgaaggccagcgccgcccgctccaccgagacccgccgcagtgtcacccaggactgcccgagcgcggtcaccgcggccatcgcgacgtctcgcagcacgctgtcactgatctcggcctgtgtgccgccgttgccccgggtctccagcccggacgggcagcgttccaccgtgacgtgctcgaagacggcggtggcctcgtcgtacacccgcagggcggcactgctcaggtcccggatctcgatccgggtgaaccggccgcggccgccgtcggtgacggcgacgccgaccttgccgcccgtgacacggcagccgtggacctctggcgctccgccccgggtcgagagcaccgcgacgttgcccgccgcggagatctcgcattcctcgaagcggccgcggccgccgttgttgacgtcgaggccggtgtcgcggcagccggtgagcacgctgtcgcgcaccaccgggtcggcgccgctcgccaccgcgatcccgaaccgcgcgtcgacgacgcgggtgcggtccacgcggccgcgggactgctcgacgtacgcgatgccctccgcctccacggattcgacgaggcagtcggtcacggtcagttccgcccgcgctcccgcgaagaccgcggccttcccggtgcgggtcagcacgcacccctcgatccgggcccgcccgccgctgacgaggaccccgtggatgcggctgccctcgatccggctggcgacgaccgagagccgcccgccgtcgatcacggcgagcgcgttgtccgcggcgtcggtgaacaggcaccgctcgacgagcccgccggcccccgcgatcagcacccggccgtgcaggaccgtgctgtcccgcagcgtcaccgaggtaccgggccgggcgtggacggcgacaccgtcgtgggcgcggatctcggtctggtccagcgtcagtgttcccgcacggcagcccaccacgtcggcgtcccggccgaccagtacgagcccctggacggcgaccggtgcgaaggtgtcgaggacggcgccccggggccgcgccaccacgaccgagccggggccccggaccgcgaccagccggacctcgccgcggacggtgagcgtctcctcgtagtggccgggctcgatctcgatcagcgccggccggccgcgccgggccgcctcggcgagggcggaggagatgtcccggtgggcgcgccggcccccgtgcggtgaaacgacgtaccgcgtgaccattgccgcctcccctgccggacagcccccgaacggtcagaggccctgccgtccgctcggacgacagggcctctggtgtacttcctcggagccccctgtcggattcgaaccgacgacctacgctttacaagagcgttgctctggccagctgagctaaggaggcgcaaccgtcctcactctacacagcggcccacatcgcgtaatgcgaaatccgacaccttcccggtgctgacaggagccgtccgggcgggtagcgtcgagcggaagtccacctggtggactagacccattcttccttccactcggatcgtccggcacgttcctgccggtagaagggattcatcaccatggcttctgtcactttcgacaaggcgacccggctgtaccccggcggcgacaagcccgccgtcgaccagcttgagctggagatccaggacggcgagttcctcgtcctcgtcggcccgtccggctgcggcaagtccacctcgctgcgcatgctcgccggcctggaggacgtcaacggcggtgccatccgcatcggtgaccgcgacgtcacgcacctgccgcccaaggaccgggacatcgcgatggtgttccagaactacgcgctctacccgcacatgtccgtcgccgacaacatggggttcgcgctcaagatcgccggtgaggacaaggccaccatccgcaagaaggtggaggacgcggcgaagatgctcgacctcacccagtacctcgaccggaagccgaaggcgctctccggcggtcagcgccagcgcgtcgccatgggccgcgccatcgtgcgcaagccgcaggtgttcctcatggacgagccgctgtcgaacctcgacgccaagctccgcgtctccacccgcacgcagatcgcagcgctccagcgcgacctcggcatcaccacggtctacgtcacccacgaccaggtcgaggccatgacgatgggcgaccgcgtggccgtcctgaaggacgggctgctccagcaggtcgacaccccgcgcaacatgtacgaccgccccgcgaacctcttcgtcgccggcttcatcggctcgccggccatgaacctggtcgaggtcccgatcaccgacggcggtgtgaagttcggcgacagcgtcgtcccggtgtcccgcgaggcgctgtccgcggcggccgacgcgggcgaccgcaccgtcacggtcggcgtgcgtccggagcacttcgacgtcgccgagaccggcggtctgaccatcaccgtgaacgtcgtcgaggaactcggcgcggacggctacgtctacggctccaccgcgtccgccgacggctcgcaggacctcgtcgtccgcgtgggcggccgccaggtcccggagaagggctccagcctccacgtggtgccgcgcgcggacgagatccacgtcttctccacctcctccggcgagcggctgtccggctgacggctccgggaagtgtgggaggggcgtcccgtcaaggggcgcccctccggcgtccgttgccgatcccggcggcgtcccgaaccccggcagaccgggccattcggccccaaccgtcaaccccggattcgaaaaaccacgtcgaaccatcccccgacagggtgactaaatgtcgccaaatcttcaccgagcgctactctcgccctcgtgacccactctgcccgccgtatcggccgttccctcgccctggtcctgcccgtcgtcctggtcctgtccgggaccctcgcggtcaccatggtcccctgggcggacacctcgtcctcccagatcctgaccgcctccgccgaggacgtctccgtccccgcgaagccccgtgccgcgcacgaggtgctgcgcgatcagctcgtcggcgagctgcagcagggcggccggccggacgacgtcctcacccacctccagcaggaggtcaaccggcggccctcgctcgccgatcactgcgtgggcatcgcgcgggccctcggacgggcggccgtggacgcgtacggcccgacgaaggcccagtcgttcgcccggcccgtctgcgacacctcgtacgcctccggcgtcgcctccatgggctgacgcacgccgcgtccctacgctggccgccatgaccgacgaccaccgatccgctgaatccgctccccccgcagccgcgttccccgccgcccccacccaggccgtcgtcctggcgggcggccaggggtcgcggctgcggccgtacacggacgaccgcccgaagcccatggtggagatcccggggacgggggtgccgatcatcgggcaccagctggcctggctggcctcggagggggtcaccgatgccgtggtctcctgcggacacctggccgaggtgctccaggagtggctggccggggcccggttgccgctccgcgtgaccacggtggtcgaggaggagccgctgggccgcggcggcggtctcaagtacgccgcccggcacctcccccaccccgacgggacctggtacgcgaccaacggcgacgtgtggacccgcttctcgctccgcgagatggccgccttccacgcggagcgcgacgcggtggccacgctcgcgctcgcccggccgcggatcccctggggggtcgtggagaccaacgagttcgggcaggtcctggacttcatcgaggccccccagtcgccctacccggtcaacgcgggcgtgtacgtcttcagcgccgaattcaccgcactgctcccggacttgggcgaccacgagcgcaccacgttcccgcgcctggcccgtgagcggcgcctcgcgggcttcccgctgccacagggggcctactggcgggccatcgacaccgccaaggacctcaccgaggccgcacgggagttggcggctcagaagggcgcctgaggcccttcccgcgccgatcgccgcccgtaccgtacgcggcttcgcgcgcccggcacgcacacggggcccgcacacgcacgggaccccacccgcacaccgggcccgcacacgcacgggaccccacccgcacaccgggcccgcacacgcacgggggcccggcacgctcacgcgcgccgggccccggtcctgccgtgccggtgtgtcagccgatgagcccgccgatcaggcccggctgcttcggggccggagccccgccgcccgtgctgctgcccgcggaggaggacggctgcctcggcgaggaggactggcggggggtgctgcgcggggtctgctgcttgccggtggtgccgcgcgtcgcggccggcgactcggagcgggtgcccgaggtccccttggtcggggcgccggacgcggtcttcccggacttggcggccggctcggtcgcgacggccgagggcgaggccgacttggtcggcgactgcttgggctgctgcggtccgggctgctgcctggcgggcgcctgcggcagcggacggcccggcaggtagttgctgggagcctcgcccggaccgggcaccgtgacgacggtggaggagcggacggcgccgccgaggagcgaaccgacgagcagcgtcagcccgcacacgaccgtggccatgacggccccgcgccgcaggacgcgccgccgcagccgccagatctcggagcgcgggccgagggtccgccaggcctcgccggcgaggcgtccgtcgagggagtagaccggggcgcccgcgatgatcagcggggaccaggcggcgaggtagatgatgtcgggcgcgtcgtaggccgggaccgtcttccagctcaccgtcatcagcagcgccgcggacagcagcgccccgaagcaggcggcgaaccgctgccacagtccgaagaccgtcagcacgccgacgatgacctggaggaaggccacgctcaggcccgcgccgacggggtgggcgagggcgaagtcgcgcagcggctcggcgagcgcccacgggttcagcgtgtgcagccaggtgaccatggagccgcgctcgccgccgtcgaagtagacggggtcgcagagcttgcccatgcccgcgtagatggagatgaagccgaggaagacgcgcagcgggagcagcacgacgccgaggttcatccggcggccggggtagtaggaggcctgcccgcggttgtcgccggcggggcgccgggattccggcccggggccggtcccggggccgtgcggctgctcgtacgggaggtcccgtacggcggacagcgggcgggtctcggcggggtccccgtagctgcgctggccgatgacggtcggcgtggcgagggtgtcctcggcgaggtcgtgggccaggtcgacgcgggggatgacctgggtggcgccgccgtcgtactcgtcgagtccccggccggcctcgcggacggcctggagcagtccgcccatggcggcggcgtcaccggcgtcggacttgccgctccagaccacgggggcccggcggcgggtggccccggcggccgccaccacggcgccacccagaacgggtgcgcggccgggggccttcgcgggcttggaacgcgcgctcgggctcggtgcgagccgcacgcggaagctggcgtggttgacgatgacctgtgcggggtcgcacggcaccttgaccatgctcagcgcgggctggtcgtcgaaccctgacgttctggtgtccacactcatctaaccgagtgatcagtgtttaggacactgccttgacgtcagggatgtgtccgagacccgtcaagatcaagccaccccgcccgaatcgggcggggtgacacgctcacgggtcatgttccgtgagccaagtggatcagtggccggaggatcaggcgcggccgcgggtggcgcggcggcgggccgcctcgtagaggacgacgcccgcggcgacaccggcattgagggactcggcgccgcccggcatcgggatgcgcacgaggtagtcgcagttctcgccgacgagacggcccaggcccttgccctcggagccgacgacgatgacgaccgggccgccgagcacctcgaggtcctggacctcgtgggtgccctcggccgcgaggccgacgacggtgatgccggccttcttgtagtcctggagcgcgcgggtcaggttggtgacgcgcgagaccggggtacgggcggcggtgccggccgaggtcttccaggcaccggcggtcataccggcggcacggcgctcggggatgaccacgccgtggccgccgaaggcggagacggagcggacgatcgcgccgaggttgcgcgggtcggtgacaccgtcgagggccacgatcagcgggtcgtcgccgtcgtcgtaggcggccgcggtgaggtcctcggggtgcgcgtactcgtacggcgggacctggaggaccaggccctggtggttgagcccgttggtcatgcggtcgagctcggggcgcggggcttccatcaggttgatgttgccgcgctcggcggcgagctggagggcctcgcggacgcgctcgtcgttgtcgatgaactgctggacgtagagcgtggtggccgggacgccgtcgcgcagcgcctcgaagaccgggttgcggccgacgaccatctcgctggtgcccttggggccgccgcggcgcggcgccgggcggcgcttggcggcctggcgggccatggcgttggcgatgcggttcgccttgtgcttcttgcggtcctcggccttgggcgtggggcccttgccctccagacccttgcgccgctggccaccgctgccgaccgtcgcgcccttcttgttggacgtgcggcggttcctgcgctggctgttcccggccatgacttctacctgtttcgttggtgctgcgatatgtacgtatgaagagtgtgccgcccggagcgccgggcagcacaccaaactcagctgcctgggctcagcgggggccgagcgtccagcgcggacccgtggggctgtcctcgatgaccagtccggactgctgcagctggtcgcggatggcgtcggcggtggcccagtccttgcgggcccgggcggactcgcgctgttccaggaccaggcgtacgagggtgtccacggcgccgtggagctcctcgccgcggtcggacccgttcccgccgtcccagtgggggtcgagcgggtccaggccgaggacgcccagcatggcccgtacctccgacaggcgcgcgatggccgcgtccttgtcgtcggcggcgagcgcgctgttgccctggcggacggtggtgtggacgatcgcgagcgcctgcgggacgcccaggtcgtcgtccatggcctcggcgaaggcgggcgggacctcgcgcgccggctcgacggggccgccggccttctcgatgacgcgctggtagaagccctcgatccgggcgaaggccgactcggcctcgcgcagcgcgtcctcgctgtactcgatcatcgaccggtagtgcggggtgccgaggtagtagcgcaggacgatcggacgccactgcttgaccatctcggagacgaggaccgagttcccgagggacttcgacatcttctcgccggacatggtgacccaggcgttgtggacccagtacttcgcgaactcgtcgccgaaggccttggcctgggcgatctcgttctcgtggtgcgggaagatcaggtcgagcccgccgccgtggatgtcgaaggcctcaccgaggtacttgtgcgccatggcagagcactccaggtgccagccgggacggccgcggccccacggggtctcccaggagggctcgccgggcttggcggacttccacatggcgaagtcgcgcgggtcgcgctttccggtctcaccggtgctctccggctggcggatgttgtcgagctcctggcgggagagcgagaggtagccggggaaggacttcacgtcgaagtagacgttgccctcggactcgtacgcgtggccgcgctcgatgagcccgcgcatcatctcgatcatctccggaacatgcccggtggcgcgcggctcgtaggtgggccgcaggcagccgagcgcgtcgtagccggagttgaaggccagttcgttctcgtagccgatggaccaccaggggcggccctgttcggccgccttggcgatgatcttgtcgtcgatgtcggtgacgttgcggatgaaggtcacgtcgtagccgcggtaggcgaaccagcggcgcatgacgtcgaagttcaggtacgagcggacgtgcccgatgtgcggggcggcctgcaccgtggcgccacacaggtagatcgagacacagcccgcggtgagcggggtgaagtcgcggatctgccgggcgctggtgtcgtacaggcgaatagtcacggcatccagggtagtggccctgtagcagtgccccgcgaccctttgggggcccggggcacctttgttgccgaagaagtgcgaccgctacgagggatcaggcccggttcgtccggtacacgagggcggtggcgatggcggcgagcccttcggcacggccggtgagccccagcccgtcggtggtggtgccggacaccgagacgggggcgccggcggcggccgcgagcgccttctgcgcttcttcgcgccgctttccgatcttcgggcgtacgccgatcacctggatggcgatgttgccgatctcgaagccctcggcgcggacgatgcgggccgcctccgccagaagggtgacgccggcggctccggaccactcggggcgggaggtgccgaagtgcgcgccgaggtcgccgacaccggcggcggagaagagcgcgtcgcaggcggcgtgggcggcgacgtcgccgtcggagtgcccggcgaggccgtcctcgccctcccagagcaggccggcgcaccacagctcacggccggtctcgaaggcgtgcacgtcggtgccgatgccgacgagcgggatcagcggcgcggcgggcgcgtcgtgccgggtgggatcagtagccatcggtggccctcctgcgggcgagtacggcctctgcgaggaccaggtcgagcgggcgggtgaccttgaaggcctcttcgtggcccgggatcaccacgacggtgacaccgagccgttccaccatgccggcgtcgtcggtggcgccctcgccgtcgacggcgatcgcgtcgtgcgcctgccggagggtggcgaggtcgaagccctgcggggtctgcacggcgcgcagccgggcccgttcgggcgtgccgaggacgggctcgggctcgccgggcttgccgggctcgacctccttgacggtgtcggccaggggcagcgcgggcaccacggcgggcgctccgtcgcgcacggcctcgacgaccgagtccacggtgtccacgggcacgagcggccgggccgcgtcgtggatcagcacggaggtgatgtccggcggcagcgcgtccaggccggcgcggacggactcctggcgggtctccccgccgggcacgaccagcagttcggtgcgctcgggcagcgcgtgctcgcccagcagcaggcgcacctcggcggcctcggcgggcggggcgacgaccaccacgagggagaccgcgcgggagcgggccatcgcgcgtacggcgtggatgagcatcggggtaccgccgagggcccgcagggccttgggggcaccgggaccgaggcgtaccccccggccggcggccgggatcaccgcggcggtgcggtggggacgcgttacgtcagacatcagtagctccgagccaggtttgtgacttcggccgacatgggtatggcctgaagggtgccgggtgcgacgcccctcgccccttccgtgacgaccggtcgagcaggctgcccgaacccggcacgccatcgcgatggtggcggtggggcagtgaggcaagagatacggatacagacatgccgcagcgcccggcaacaggcctctcgtggaggagagacccagtcatcgggcaccgcggcaagctgcgcaccacatggtgcacggggactcgcgtcaggacgcgagcacctcgtcgaggagggcctcggccttgtcctcgttcgtgttctcagcgagcgcgagctcgctcaccagaatctggcgcgccttcgcgagcatgcgcttctcacccgcggaaagcccgcgctcacgctcacgacgccacaggtcacgcaccacttcggcgaccttgatgacatcgccagaagcgagcttctccagatttgccttgtagcgccgggaccagttcgtcggctcttctgcatacggtgcgcggagcacctcgaagacccggtccagcccgtcctggccgactacgtcgcgaacgccgacgaactccgcattgtccgcaggcacacgaaccgtcaggtcgccctgagcgaccttgagcaccaagtaggtcttgtccacgcctttgatctgacgagtctcaatggcctcgatcagcgcggccccgtgatggggatagaccacggtgtcgccaaccttgaacgtcatgtgacaggtaccccttccgtggctatccagggtaacacgagaactgactgttatgaatggcgttttcgcaggtcagggcacatctcggggcttgacaacagcaacaggaacgtgctgcggagagcttccggaagcgggtattcgcaggtcgggggcgctgcgcggaccgggcgaaagggccacgctacacctgcccggcacccccatcagtgtgacgtacgtcccgttttgccgggttccgagtcgggaaaccgaactactccgtccgactggcggccccctcaccgggcgggttccggcccaatcctgaattgatcacgaagtgccgttcgagagaatccggaaattgatcaacgggggtccggcacgggatatgcgagcgcgtcaagatcggcgcggtggacggcacctcggaatgcaagatcgcggggcgctcccagggtgggggccgccctgcggagggtcgggtgcgggggcggggcggcggctcggtaacctaagcgcgctgacacacccttagagcggctttacctcggccgttccgagcgcccacccgccccttccgttcgtccaaggagttgccgccgccgtgagccgcagccttcgacgcggcgccctcgccgccaccgccgtcgtgttctcgatcgcctcgctggccgcatgcggtgcgggccgggatgcgcagaccctccagatcaagccggacaacgccgccgccaccaagggcgacatcgaggtccagaacgcactggtgatcacccagggccagaagggcgagaagggccccgcggtcgtctccgcgacggtcttcaacaacggcaccaaggcacagacgcttgacggcatcaccctcccgggtggcaagggcaaggtcgcgctgaagcccgccgagggctccggcaagatcaccgtgccggccctcggctacgtggtgatcggcggcaagggcaacgcctccgccgtgatcgaggacggttccgtggccgcccgggacggcgaagtgcaggacgtcgtcttccagctgagcaacgcgggcggcgtcgagctgcaggccttcgtggtccccgccaccggcgccttcgccccgttcggcccgtccgcggcccccgtcgcggccccgacgcccgccgcgtccccggccacgcccccggccgcgggtaccaccccgtccggcactccctcgggcactccctcgggcgcggccaccggtgcggccgcgggcgccaccccgtccggctcccccgcgggcacgccgtcgggttccccgtcgcacgccgcgggccactgacgcggacatacgcatacgggaagggcccccggccgctgatgcggccgggggcccttcccgtatatccggctccggaccgcgcgtacgccgtcggcctacggctcgaacttgtagccgaggccgcgcaccgtcaccaggtagcgcggtgcgcccgggtccggctcgatcttggcgcgcaggcgcttgacgtggacgtcgagggtcttggtgtcgccgacgtagtccgcgccccagacccggtcgatgagctgcatacgggtcagcacgcggcccgcgttgcgcagcagcatctccagcaggtcgaactccttcagcgggaggtccaccttgccgccggagaccgtgaccacgtggcggtcgacgtccatccgtacggggccggcctccagggccgccggggtgacctcctccggctcgccgcggcggcgcaggaccgcgcggatgcgggcgaccagctcgcgggaggagaagggcttggtgacgtagtcatctgctcctatctccagcccgacgaccttgtcgatctcgctgtccttggcggtcaccatgatcacggggacgttggagcggccgcgcagctgccggcagacctccgtgccgggcaggccgggaagcatcaggtcgaggaggacgaggtcggcgccgttgcgctcgaactcgtcgagcccgtcggggccggtcgcggcgatggcgacctcgaagccctccttgcggagcatgtaggacagggcgtcgctgaaggattcctcatcctcgacgacgagcactcgggtcacggaaggacctccggggcaggaatggctggagcggttctgggtcaggcaggggtcgggtgggtgcggggggccgccaccggggccggggcggctgcttcagggagtcgcagggtgaacgtggaaccctggccctccgagctccataccgacacctccccgccgtgcgaggccgccacgtgcttcacgatcgcaaggccgaggcccgttcctcccgtggcgcgggagcgggccgggtccacgcggtagaagcgctcgaagatgcgctcgcggtccttttccgggatgccgatgccctggtcggtcacggcgatctcgatcaagtctcccccaggagccgtcaccctgcgtccggcgatgccgacgcgggtgcgggcggggctgtagttgacggcgttctcgaccagattgccgagggcggccgcgagctgtccgcggttgccccatacccgcaggtcggcggtgccgcccgcggccatggtgatctgtttcgaggaggccgtgtggcggcagcggtcgatggcttcggcgacgagcgtgtccacgcgcacgggctcggcgtcctccagcgggtcgtcgttctgtacccgggagaggtcgatgagctcctgcacgaggttgatcaggcgggtggactcgatctgcatgcggcccgcgaagcggctgaccgcctcggggtcgtccgcggcgtccatgacggcctcggacagcagggagatcgccccgaccggggtcttcagctcgtgggacacgttggcgacgaagtcgcggcgcacggcctcgatgcggcgggcctcggtgaggtcctcgaccaggaggagcaccaggcgggagccgagcggggcgacgcgcgccgagacggcgagggcctctccgcggccggtgccgcgccggggcaggtccagctcgacctggcgtatctccccgtcacggcgggtgtcgcgggccatgtggagcatcggctccacggcgagcttgccgccgcggaccaggccgagggcgtaggccgccgagctggccttgaccaccgcgtcgccctcgtccagtacgaccgccgaggaccgcagcaccgagaggacggtgtccacgccgggcggcagcaccgcgttgatgtcggggcgcatggagctccgggtggggcgggcctggtcgcgctcgctccagcggaacgccagcatcgcgatcacaccggtgcaaagaccggcgatcgctgcagctgcggcgaccgccgcgttcacgtccatggatccaggttaagcaggcgcgacgacacttccacagccgttcgggtggcacctcgaacagtcgtcgcccagagttcaccctggcgacggggttgattcacttgtggtgccggagtcggacgcgtttgcggctcacggtgtcaacgtggggccgctggccgccccggcccgcccccgggcagtaccgcagtagtaggtcgagagagggacacgagacatgcgcgacgcgtaccacgaggaactggactcgatcggagaaggcctggtcgagatggcccggctcgtcggctccgcgatcgggcgggccacgacgtccatgctcgacgccgacctgaagctcgccgagagcgtcatcgccgccgaccagaaggtcgacgacctccagcacgacctggaggcgcgcgccatcgccctgctggcccgccagcagccggtcgccaccgacctgcgcatcgtcgtgacctccctgcggatgagcgccgacctggagcgcagcggcgacctcgcccagcacgtggcgaagctcgcccggctgcgcttcccggaccgcgccgtgccgcgggacctgcacgcgaccatcctggagatggggcagctggcgcagcgcctgatggcgaaggccgccgaggtgatcatcacgaaggacgtcgacctcgcgctccagctggagcaggacgacgacgagatggaccagctgcaccgcacgctgttccagcacctgatggacgaccgctggaagcacggcatcgagacggccgtggacgtgaccctgctgggccgctactacgagcgcttcgcggaccacgcggtgtcggtggccaagcgcgtggtctacctggtgacgggtgagcacgcggacgacctccagcagccgacccaggtcgacggcgtctgacccaccggcaccggaagcggggaatccggacgggggcggcccgaccgcgggccacgccgagccccaatgcgccgttgacgcgccggtaccgctgggcatgaatgagggcgagggcggtcgtcgtacgtagtcccgtatgccgcggggcaccgcccctgcgaggaggaaccatgcccgattcccccgtccccatcaccccggagcaggagcagtccccgaggcccgagccgctgcggctaccgctgctcgcggcctgcggctgcggctccggctgcggctgcggctgccagtccggcgccccctgccagtgcggcggctgacggcctccaccggccgcacgcgaggacgggccccgtccgagttccctcggccggggcctttcccatgcgtgcgcgcggaaccgtcccgtacgtccgcgggctatctcaggagccagttccgggtcagctccatgacctccgcgcgggtgcgagcgccgtggtcgacgtggatgaagtgctcgccgatccgcagcgagtaggcgagcaggcagcggacctccacgtcgtcctcgtcggtgcagatggcgcggaacagcgaacgcaggtactccatgcgccggttgtcggtacgccgcacccgctgcgcgacgtcctcgtcgcgccgggcccagtcgcggatggcgaggtcggccgtggtgcccctgaccggcccgtcggccgacgaggcgatcgcgaacagccgctccagcctggaccgcgcgtctccgccgccgctctcgacctgctcgatcacggcctcggcgacctcgtgctcccaggtgtcgagcatctcggtgagcagcgcgccccggctgccgaagtacccgtagaagccgcccttgctgacgccgagcgcctgcgccagcgcctcgactcggacggcctcggggccgccggccgcgagggcccgcagcccttcctcgatccatttaccgcgcggtgtgcgggtcgcgcccatgctgtgctcctcctcaggcgacccccgtctatacggtgccgtatagacaggtgctaacctcgatctatacggcatcgtatagataggggccgaccgatgagactccccaagaccgcccacacctcccgcccctggcggatccacgagatcgccggagacttccgggtcgaggacgtgtgggcactaccgaccccgggcgggcccgacgacctcgcccgcctggtgcgccagttcgcggggggcaccggggatccggtcccctcccccgtggcgcgcgtcctcttcgcggcccgccgcgggctgggcaggctgttcggctgggacaagcccgacggcggcctcggcacccgggtccccaccctgcgcgaccggctgccggccgacctccgcgagggcgaacgcggcccggacctgcggtcggccccgttcacctcggtcttccagacccacgacgagtgggcggcggagtccgccaaccggaccatgcacggggtgctgcacatcggctgggtcccggacggcaacggcggctaccgcggccagctcaccgtcctggtcaagccgaacggccgcctcggcagcctgtacatgctgggcatcaagccgttccgccacctcggggtctacccggccctgctgcgctcgatcggccgcgaatggcacgcgaacccgccgacggacgcggcctgacccctgcgtgcgacactcctgccggagatcacgagggggatgggacggatgcgcggcaggatcaggacgctcgcggtggtcgccgccgggatcggcgtcatcgtggcgggggcgctgctgtccccggacggcgacgcctcggcccgcagcgcctgggtggcggagccgccctcgggcgagccgcggtacagcggtccggacccggcccgggaggacgtgctgggggacttcgacttcgccacggccgctgcgggcgcgggccctgcgcaggcccgcggctccgcgctgcacgcgtccgagtgcgtggcggcccgggctcacgacggcccggccgacgacgagcagctgatcacgatggtgagccggttgaccgaccgcggctggcgggtcacccggcgccgtaccgccccgacggcggtggccatggccaagggcacctgggatgtgaccatcatccccgaaggcccgaccgacccgccgttcctctccctcctcgccctccgcatcaccccggcctgcgagaagctgctcgactcccggtagcgggcggccaagaggcccccggcccgctgggatcagcgtgccgggggcctcttcgagcgtggggttacttcttgccctggttcttgacggcctcgatggcggccgccgcggcgtccgggtcgaggtaggtgccgcccggggtcaggggcttgaagtcggcgtccagttcgtagaagagcgggatgccggtcgggatgttcaggcccgtgatgtcggcgtcggagatgccgtccaggtgcttgaccagaccgcgcagggagttgccgtgcgcggcgaccaggaccgtgcggcccgccagcaggtccgggacgatgccgtcgtaccagtacggcagcatgcgctcgacgacgtccttgaggcactccgtgcgcggacgcagctcgttcgggatcgacgcgtagcgcgggtccgcggactgcgagaactccgtaccgtcctccaggaccggcggcggggtgtcgtacgagcggcgccacagcatgaactgctcctcgccgaactccgcgagggtctgcgccttgtccttgccctggagcgcaccgtagtggcgctcgttcaggcgccaggagcggtgcaccgggatccagtggcggtcggcggcctccagcgcgagctgcgccgtgcggatcgcgcgcttctggagggaggtgtgcagcacgtcgggcagcaggccggcgtccttgagcagctcaccgccccggaccgcctccttctcgcccttctcggtgaggttgacgtccacccagccggtgaacaggttcttcgcgttccagtcgctctcgccgtggcggaggaggatcagcttgtacggtgcgtcggccatgcgtacgagcctagtggacgcccggcggcgctcgcgcgcggcgcccggtcccggcggattgacggcaggcgtcaatccggtggcgttcggatccccgaccctcgtaatgtgcggactgcaagagtgacgcttacaaactgacgcccccggggggaacttctccatgcccgtcgcccgtatcggacaagccgcccgggagagcgtgtcggggctgccgaccgcgttctggtggctctggacgagcaccctcgtgaaccggctcggggccttcgtcgccaccttcatggccttgtacctgaccctggaccggggctactcggcctccttcgcgggactcgtggtcgccctccacgggctcggcggcgtgctctcctcgctcgccgccggtgtgatgaccgaccggctcgggcggcggcccacgctgctggcggcccaggcgtcgaccgccttctcggtggcgctgctcggcttcatggagcacccggcggcgatcgctgccgtggcgctgctggtcggcgtgacctcgaacgcctcgcgcccggcggtcgcggcgatgatggcggacatcgtccgccccgaggaccgtgtacgggccttcgcgctcaactattgggccatcaacctcggcttcgccgtcagcgcgaccgcggcgggcgtgatcgcggagtacagctatctggccggcttcctgggcgaggccgcactgacgctggtctgtgcagtgctggtcttcgtcaagctgcccgagtcccgtccggaacggcccgtgagcgggtcggccggcgccgccgacgagcccgcgatcgggctcgggacggtgctgcgggacgggcggttcatgggcgtggtcgggctgtcgttcctgatctcgctgatcttcacgcagggctcggtcggcctgccggtcgccatgggctccgccggcttctcgcccggggactacgggctggtcatcgcggggaacgggctgctgatcgtgctgctgcagatcccggtcacggggttcatcgagcggcgggacccgcagaagctcctggtgatctcggcgctgctggccgggtacgggttcgcgctgacggccttcgccgggccgctgtggacgtacgcgctgacggtgtgcgtgtggacgctggccgagatcgtgaactcgccgacccagatgagcctggtcgtacggctgtcgccggtccacgggcgcggccgctaccagggggtctacaacctgtcctgggcggtggcctcgctggtggcgcccctgatggcgggcctcctgatcgaccggttcggggccgactggctctggggggccacgggcgtgctgggcacggtggcggcggccggctactggctgctgatgcgggggctctccgagggcgacgcgggcccgggcgcggccgtggccgtggccggtggagctccccgaccggcgaccaagccggttccggccgacgccgaggtgtagcgcggcccgggccgctgccggggctccggccccggaccccgcctcacgcgccggcgaggccgtatctacgacggacgcgtcaggtgcttgaaggcgtcgaggttgaaggtcggctcgccgcgcgagacccgccattcgtactcgcgccggatcgcgctcgcgaagcccagctccagcagcgtgttgaaggagccgtccgccgcctccaggaccgtgccgagcagccggtccagctcctccgggtccacgaccgacagcgggagccgggccgtcaggtagatgtcgccgaggcggtccaccgcgtacgccatgccgtacagcttgaggttgcgctccagcagccagcggtggacgcccgcctcgttctcgtcgggatgccggatcacgaaggcgttgaccgacagcgagtgccggccgaccttgagcgagcaggtggtgctcagcttgcgggtgccggggagctggacgacgtacgagcccggctcggggctctcccagctcagctccgcggcggtgagcgcgctctcgatgatctcggcggtgtcagccatggtgggagcgtacgcgacggcgatgatcatgcatggccgcggtgtagacgtcggccgtgccgctcgccgcggtgtcccagccgaagaactgcgcgtgccgcgccgcctcggcgcccatccggtccgcgagcgccggctcgtccacgaagcgccgcagctcccgcgcgtagtccaccgggtcgtgcccgggtacgaggatccccgtgaccccgtcgttgacggcgacgggcagcccgccgacctcggcggcgagcaccggggtcccggcggcctgggcctctatcgcgacgagcccgaaggactcgctgtaggagggcatgaccagcacggacgccgcccggaaccagtccgcgagcccgtcctgcgcgaccggcgggtggaagtgcacgaggtcggcgatgccgagcttcgcggcgagcttctgcaggccctccggcttggccaggccgctgccgctgggcccgccgacgacggggacgaagaggcggcggcgcagcgaggggtcctggtcgaccatgacggcgacggtgcgcagcaggatgtcgggggccttcagcggctggatccgcccggcgaagagggggatgacggcgtcctgcgggaggccgaggcgggcgcgggcggcggagcggccgtcgccgacggtgaaccggtcgaggttcacgccggggtggacgacggcgaccttggcggggtcggcctcgtagtgccggacgagctcgtcggcctcctcggcggtgttcgcgatgagccggtcggcggcggccacgatctgggtctcgcctatgacgcgggcggccggctcgggggtgtcgccctcggccagcgccgcgttcttgaccttcgccatggtgtgcatggcgtgcacgagcgggacgccccagcgttcggcggcgagccagcccacgtggccggagagccagtagtgggagtggacgaggtcgtagtagccggggcggtggccggcccaggcctgcatcacgccgtgggtgaaggcgcacagctgggccgggagctcctccttggcgaggccttcgtaggggccggcgtccacgtgccgtacgaggacgccgggtgcgagctcgaccacgggcggcagcccgccggtggtggcccgggtgaagatctcgacctcgatgttgatcgcggcgagccgcttggccagctcgacgatgtagacgttcatcccgccggcgtcgccggtgccgggctggtgcagcggtgaggtgtgcacgctgagcatggccacgcggcgcggcttgcggtggtggccgacggccgggaggcgcagccggggcggctcgtggcgggtggcacgggcggcggcgaggcggccgctgaggcgggacacgtactggctcaaaggaccagtcctctcggctcggacggcgcgcgcacgacgctcggacgacatgcgggacggcatgacggcgagggcgcgtaggacgccctgcaaggagtgcaacccggatggcagtcccccgcattccggggtgtccggttttcctggaggtttcctcgtattcggtggcgcgtgacggcattttcatggtgcgcgggccctccgcttaccctcggctcatggcctcccgcagtaccccgccctccagccgcgcgcccggccgccctgtgggctcggtgacgcgcgggacgaccaatccgaaccggttgcgccggatggaccgctggatcgcggccacccacggggccgcgctgcggcgcgcggaggcgccggtggcggtggacctgggctacggggccgctccctggacggcggtcgaactgctggcgcggctgcgggacgcggcgccgcgggtgcgcgtggtcggcatcgagatcgagccggcccgggtggcgggggcgaagccgtacgagcgggaggggctgagcttccggcacggcggtttcgaggtgccgctggacggtggggcccgcccggcgctgatccgtgcggcgaacgttctgcgccagtacgacgaggagcaggtcgccgaggtctgggcgcggctgtgcgggcggctggccccggacgggttgctggtggaggggacctgcgacgagatcgggcggcggcacgtgtgggtggcgctgggcccggagggggcgcgcacggtgacgttcgcgacccggctgggctccctggagcgcccgtcggacctggcggagcggctgccgaaggcgctgatccaccgcaacgtgccgggcgaaccggtgcacgcgttcctgcgggacttcgaccgggcgtgggcggcggcggccccgtacgccgcctacggggcacggcagcgctggatccggacggcgcgggcgctggccggcgactggccgctggtggacgggccgcggcggtggcggcagggcgaactgacgctgccctgggaggcgttgcgcccggtggggtgaatgcggcgcgcggcggaaccgggggcgggggcggtccgttgaaccgtgcggggcgggaacggcgtccgttggggcggacaagatcggatcgccgtccacaagggtgttggaattcatcgactcgtggcaccatcccgatggcagcgacaagttactgatgaatagtcagatctgatacgggatctggctcgggtgcctggggggaccatgggagccgcaaggcaacggcgaggcgcaagcactctcgtgctgctgtgcacgatggcgatactgacggcgccgggcctcgcgacgggcctcgcgtacgcggctccggcggcgccgcccgcgcccgccgcaccgacggcaccggccgctcccctgcccggaccgggcggcaagtccctggagcaggtccgcaaggagatcgaggagctgtaccggcaggcgggcagcgccacggacgcctacaacctcgccgaggccgagaccaaggcccagtcggccaagatcgtcgagatcgccaatctcatcgtcgccggcaaggagcggatcgccaccctgaagaaccgggcgggcgccgccgcccgcgcccagtaccgctcgggcgggatgccgccgggcgcgcagctggcgctgagcgacgacccgaaccactacctcgacggagcgggccggctgcgccagggcgagaaggccgcctccgacatgctctccgaactggaccggacccaggccgacttgcagcgctacgcccaggaggcgggcgagcgctgggagacgctggaggccaaccggatcaagcaggagaacgcgaagaaggagatcgaggagaaaatcaggaccgcggaggacctggagagcaagctgcaggccgaggagaaggcccggctgatccagctggagcaggaagcccagtacaaggcgcagacggcgtggctgtcgacgggcgcgatgaaggacgtcagcggcaaggcgacggatgcgggcaagcgggccgtgcagttcgccacggcccagatcggcaagccgtacaaatggggtgccgtgggccccgggtccttcgactgctccgggctgacctcccaggcctggctggcggcgggccggggcattccgcgcacctcgcaggagcagttgcggctgctgccgaaggtcgcgctgaaggacatgcgcccgggcgacctgatcatctacttcgacgacgcgagccacgtcggcatgtacgtgggcgacggagcgatggtgcacgccccgcgccccggccgggacgtgacgctggcgggcgccggctcgatgccgatcaaggcagtggtccgccccgacgcgtagcccccgcggggcggcccggcgctccggccggggccggatgcgcgggccggggccggatgcgcgggagggtgacgcaggcaacctcgcggggctcggacacgtctcgctggacgggacggaacacggccccgccgtgacctttgtcatccagtgaggccgattttcccccgcgataaccgcatatgacgcaggccctcgccaagaacggcattccgtttgtcgggcagggaccgctagggtctgccggacgagcgcaccctcggggggagggaaggaaccggagacgatgcccgtacccgtaccgcggcagagggacatccctgccacggagagcggtcaggccgttctgcacaccgccgccccggccatagccgccccgggcgtcgcgcaagcgacccctcaagcggccccgcacacgacccccctgaccctcctggtcatcgaggacgacccggccggcggcctcaccgtccccgagatcctcgacgcggacggccaccgcatccggctccgcaccgcccgcaacctcaccgaggccgagcggctgctcacccccgacgtgcactgcatcctcctcgacctgtcccttccggacgccagcgcccgtacgccgggggtcgcggccaacggcacggcccacagctcggcgaacgggaccgggaccgggaccgcgatcggcacggccaccgccaccgccgtggaccagctggtcgccctccgccaggtgctgcgcctcgccccgcgccacgccgtcctcgtactcaccgacgaggacgacgccgagcgcgccgccgaggccgtccgggtcggcgcccaggacttcctcttccgggacgagctggacggccggctgctgagccgcgccatccgctacgccgtggagagaaaacgggcggacatcgcccagtacaagctcgcagaatcgaaactgcgcgcccaggagaacgcccggctggaacgcgggctgctccccacgcccctcctggagggatccgacctccgcttcgccgcccgctaccgccccggccgcagccgggccctgctcggcggtgacttctacgacaccgtccgcacgcccgacggcaccgtccacgccatgatcggcgacgtctgcggccacggccccgacgaggccgcgctcggcgtcgagctccgcatcgcgtggcgcgccctgaccctggccggactctgcggcgacgacctgctggccaccctccaggaggtcctggaggtggagcggccgtgcgaggagatcttcgcgacgctgtgcacggtcgacatcgccccggacggccgtcgcgccggcctgtgcctggccggccacccggccccgctgatatcccggccgggccgccgcgcgcggctgctcccgtacgagaacagcggcccggccctcgggctgctgccccgggcccgctggccgcgccgccaggtggagctgggcggcacctggagtctgatgctgtacaccgacggcctcatcgagggccacatcggcgagggcaaggaacgtctgggccaggacggcatggtcgacatgatcaaccgccacctggaccgcgggctgagcggtgagggcctgctggaggcctccgtcaccgaggcccgccgcctcaacggcggcgaactgaccgacgacgtggccgtggtcctgctgtcccgcgccgagggctgagcccaccgggccccggccggggcgcgccgcggtcgcggccgccgcgcgcagcccgcccaggccgtctcttccggcctagcgtccgccgttgtagggcccgtacggcccgtcgctgctgctgccgccgccgcgtcggccgccgccgcccgagacctgcttgagggccgggcgtacgtcgacgaagaacacgatggtcgcgacgagaccggcgatctgcaggaacatcatccccgggacgaagcccacggccacggtgacgccgagcaggaccagccagaaggtcttgctctgcttctcggccgcccggtacgcgtcctcccgtgccaccagggcgaacacgaaggccacgacggcgagcacccgcatggcgagcatgagcaacgggatcacgcccagatcgaacccgttcatcaacatcgcttcgaccgccttctcaactactgcttcacacttcggatgccgcccgactccacgctaccggcacgtgccccttcatgaaccacaacgggccgggcacctgaagggtgcccggcccgccgtcgctcatgcggctgcgtctcagctcgcgtcgtccgccgtgaccgcggccttcttggccgggctcttgcgcgcggtggtcttcctggcgccgggcttctccccgtcggcggccgcggccaccggctccggcgccggctcggccaccggctcggcctcgggctcgacggccacggcgatgtcgacgatctccgcggagacctcgccccgccagttccgtacggcctgctcgccgtgcacggcgaccttgtcgtaggtctccttggcgcgcaccgcgtactcggcggccacgccgacaccgcgcagcgccaggtcctgggcggtctccccgagcttcttcgggtcgatcgcgccgagcacctcggcgaacttggcggtgaccgcgtcctgcacagccttcgggtccgtgttcttcacggcctcgatgcgcgcgggagcctcggcgcgcagctgctcgatcaggtcgggcaccttcttggcctgctgcacggcgagatcggccgtgcccgcggcgaagtagaggggagtggggtcggtgagggtcttcttcaggtcatcggcgatggccatgtgctggtcctcccggatcaacttcggttcgtctacgacggcatctcgtcggcgggcgcatcgagcgcgttctccttgcggaacgactcgtagatctggagcagcacctgcttctgccgctcgttgatggacgggtcggcgagtatgacggctcgcgtctccacctcgtccgggtcccgctcgtccaggatcccggcctgcacgtacagcgtctccgcggagatccgcagcgccttggccagctgctgcaggatgtccgcgctcggcttgcgcagcccgcgctcgatctggctcaggtacggattcgacacccccgcctgctcggccagctgccgcagcgaaagctgggcctgccggcgctgctcacggaggtactcgccgagatttccgacgttgagcgatgccatgctcagatcctgcccgaccttgctaactattgcaagcgacatgcttgcagcatctcccacccggcggcgggcggcgatccgctcagtcgccgaactcgagcccgggccgggtccacagggtgaggtcgctgctggtggcgaccgccagggtgcggccggagggggagaacccggctgcgcggagctccgagtaatcggagtggaagacgtgccaccagctccctcccggcgggccttcgtgggccccgccgtcgacggagaggatgacgcggtcgcggggccactcggggctgaccacgtccagggtccagccgtccggtgtggtgcggtgcaggccgccgccgaagagtccggcgatgcgtaccggggcgccggcgatcgggccgagcccggggcaggcgaggtccgggtgggcgtcgggggtgctcgtgtcgaagtccgggtcccggtcgcgggcgatcctctcgccggtgaccgcgtcgaagagtccgtggccggcgctggacacgaccatgacgaggtcgtgcccacggtcggggtggacggcgaagccgatgccgagcaggcccccgatgggcgtccggcggtccggcaccggccgccagggctccggggccggcagcgcgggggcggcgatgtagcgctcgcgcagcctctgctggtactccgtgatcaatttcgtctcctcggttcccgaaccacgcgtaggtcttcttgcgccggacccgctcgcctacgggatggagagccgcacctcccgcaggtagccggccggaggtcccggccgcggcaggctcacgccggggtgcgggcccggcccgagggcctccaggacctcggcggccgggtacccgaacaggtcgacgccgtggaggaccaccgggacggcggacggcccggccggttccggcccgcaccggccgaggtggacggccgccagaccgtggcggtcgtggccggtgcggccgaggcggtccgggcagtccccgtaggcgagcagttccaggccttcgcagcgggcggtgaaggcccagcccgtcccgcagacccaggtgtcccgcacgtccgccagggtcgcgacggcccaccgggccgcccgcccggacatgccgaaccgcaggacgcccgcccggttcggcagggccagacccgtgcgcggcagcacctcgaacaccgctgggccgccgcgcggcgtcaggccgtgccgatgaccaccgtcgcgtacagctcctccgaggtcaccgcccggaccgcgaggcccgcggaggtcagggccgaggccgtcgacggggactggcgcgcgctggtctcgatcagcaggtggccgcccggggccagccagggcagggcccccgccgccacccggcggtggatgtccagcccgtcggccccgccgtccagggagaccagcggctcgtggtcccgcgcctccgacggcatgagggcgatctcctccgtcggcacgtacggggcgttgaccaccagcacgtccacccgtccgcgcagcgcggacgggagcgccgcgtacaggtcgccctcccacacccggccgccgtacggggcaacgttgcgccgcgcgtacgccagcgccgccgggtcgatgtccgccgcgtgcagctcgacgccgcccggcaggcccgcggccaccgccgcgcccagggcgccgaccccgcagcacaggtccagcaccacggcaccgggccgggccagcgccaccgcctcctgtaccaggaactcggtgcgccggcgcggtacgaaggcgcccgcgccgacctccatgcgcaggccgcagaactccgcccagccgaccacgtgctccagcggttcgccgcccacccgccgggccagcagctccgccaggtggtcggcatcggcggcggccccggtcaggagctccgcctcctcctccgcgaagacgcagcccgccgcgcgcagggattccacaagtgatgtcaacaagctcagtcctcttcagaagatgtccgggcaccacgggttgcgcgcggtacggaacaccgcgtcggccagcgcggccgccccgggccgctgctgcgtcacccggcccagcgcggccagccgcaccgcggaagtgccgcccaggtacagggagcccagttcggccacgtccagccgcaggtccgccggcgcctcggtccgctcgcacacgccggtgcccgcgtccagccggtagcggcccgccgccgggcccgtctcgtccgtgacctccaggacgagcaccccgggcacctcgtacgtccgcgcgcccagcgcccgtacgacgtccagcacccgcacccacaggaagtccgcggtggtgaggacccgcgccgcccgcgggtcgggcagcagctgcggggcgaggtcgtcgggggcccggtagccggtgcggaccttcgtcacccagtcgatcgagcacaggaactgccacaacgcccgctccgcctgcggggtgacggccagcaggtacttgacctgcacggtgttctccggaagcttcgcgtccgtccagtggtcgtccgcgctgtacacggcgaggccggccacctccccctccgccgtccggtacacggcgtggaagttgtccttgtacggccggtacgaccactcctccaggccggtcgccaggctccaccagcgctcgtcccggttcacggcaccgggcgtgagcgcccgcagccgctcgtgcagcccgggccccacccgccgcacctcctcgacgtccaccaggtcgatgcggccgccgtcgacgggcgccgacagcctccggtcgagcccggtgcgcggtacgtcgatctcccactccacgagggaggtcgcgggcccgaacccgtaccgtccgtagatcgggtactcggcggcgatcagggtcatcagcgcgtcaccgcgcgcctcggccgccgcgaactcgccagccatcatccgggtcagcagaccctgccggcggtgggtgggcagcacggccacgttggagacggccgtggagcggacggccgccccgccgggcacggtcagctcctgcgggaaggagcgcagggccgccacgcagcggccggtgtcggggtcgaacgccccctgcatccgggagaagtcgcagtacttggcgcgctgcgcgatgtcggactcggtcacccgggggctgaccaggaaaccggtgtgcacggtgcgcacccagtcggggagttcggattcggctatcggccggatgtcagcactcatagcggcccacgctaatcccccgaccgcctccggtcgcccgaattttctacgccagcaggtcgtccacctgcgcctctccctcccggtaccggcgggtgatctccgcactgcagtcgtccaccgtgcgctggagctgctggcggcgccgcgagacctgctgttcgtagcgcaccagccgccccatcccgtcgtgcagttcgtcgtccgtacgggcgcccaggtccgacagctccacgtcggacagcatctccgcggccagcaaccggtactcctcgctgtgcggggtgccgagcgtgacgtgccgggcggaggcactgcggctggagggggcgtcggccaggatcaccgagagccggtccaccaccggcgcctcggggtccgtccgccgggccagctccgcccgcaggatgtcgatgcggccctggagcaatctgcgtacgtagctcagatcggcctcgtcgcgctgcgcgtcacggcgcagcgcgcgcagttccggcagcccgagcgcggcggtcggggccggcggcccctgcgtctcggccgtgcgctgcgcgggcggtcgtaccgcggcagctgcgacggaggcgggtgatgcaggtacggaggtaccagaagtattcatgcgttcaggtccgtcccctcgaccggtgcggcgcacccgcaccgccttcgtgcatcgtgccactccccgtggcccccatgcagtcccagtgcacccgatcggccccggacgggtgcaagcctggtacacaggtggtatgcgagcagtggtgcagagggtggacggcgcgagcgtcgtcgtgggcggcgagaccgtgggcgagatcgtcggcgaggggctgtgcgtgctggtgggggtgacccacgacgacaccccggagaaggcggagctgctggcccgcaaactgtggtccgtgcggatcctggagggcgagaagtcctgcagcgacaacggcgccccgctgctggtgatctcccagttcacgctctacggcgacgcgcgcaagggccgccggcccacctggaacgcggcggctcccggcccggtggccgagccgctggtggacgaggtcgtggcacggctgcgcgccctgggcgcgacggtggcgacgggccggttcggcgcggacatgcgggtctcgctgaccaaccacggcccgttcaccctcgtcatcgacgtctgaccgcggcggtcagggcgctacgacgacctcctgcgcggcggccgtcttcccggccagcagcggcgcgtccaccggcacgttccgcttgaccagcgcgagcgcgatcgggcccagctcgtggtggcggacggccgtggtcacgaagcccagctggcggccctcctccccgtccgaggcgagccgcaccggggtgccgtgcgccgggagcagcacctccgagccgtccaggtgcaggaagaccaggcggcgcgggggcttccccaggttgtggacgcgggcgaccgtctcctgcccgcggtagcagcccttctgcaggtgcacggcggtaccgatccagcccagctcgtgcgggatggtgcggtggtcggtctccaggccgagccgcggccggtgcccctcgacgcgcagggcctcgtacgcgagcagacccgcggccgggccgtgcgcggcggcgaaggactccagctcggcgcggggcaggaagacgtcccggccgtacgcggtctcccggacgacgtgctccttgtcctgggcgacctcggcgatggagccggccggcaggtgcacgaccgcgaactcctcggtgcggtcggcgacttcgacgcggtagaagaacttcatggactccaggtaggcgatcagctcgccctgggtgcccggctccacgtgcgcccatgtggtctccccgtcgtcgacgaggtagagcgcgtgctcgatgtgcccgttggcggagaggatcagcgcctcggtggcctgcccggccggcagctcggtgaggtgctgggtgagcagcaggtgcagccagctcaggcgttcgggcccgctgacggtgacgactccgcggtgcgagaggtcgacgaagccgcgcccttccgtgagggcgcgctgttcgccgtacagctcgccgtagtgggcggcgacgccctcgtcacggccttcggccggtacggcgccggggagatggagcaaggggctgctggtcatgggaccaagcgtacgaccctgctacgactgggcggcacgctgcttcgcggcgcacttgcggcacaggccgaagatcgcgaagtgcttcatgtcggtctcgaagccgaaggcgccacggagcttcgcggtgaactcggcggcgatgtccacgtccgcctcgatgacctcggcgcagtcgcggcagaccaggtggatgtggtggtgccggtcggcgaggtggtaggtgggggccccgtgcccgaggtgggcgtgcgagacgagcttcagctcctccaggagctcaagggtgcggtacacggtggagatgttgaccccggaggcggtcttgcgcacctcggcgaggatctcgtccggagtggcgtgctccagggcgtcgaccgcttccagcacgagctggcgctgcggtgtcagccggtatccgcgctgccgcaggtcgctcttccagtcagagctctcggtgtccaggctgctccccacccggccagtgtatgcgcgcgaaggggaccgcgggcgatcccgcggtcccctttcgcacagcctttcgcacagccgtgcgcacagcccgtgggcgcggtcgcggaccgggcccgtggactcagcggaagaaggcgatgccgtcgtccggcatgtccgggaggttgcgcgccatctcggcgacctcctcgggcgtgacgaccttcttcagctgggccgacatgtacggacgcagctcgacgtccggggtggccttctcgccgacccacatgaggtcgctcttcacgtagccgtagagccgcttgccgccgctgtacgggccggaggccgcggtacgggcgaccgcgtcggtgaccaggtcgatctggggcttctggtcggcgagctcgccgtaccagacctcgacgacgccctggtcgcggaccatgacgatctcgaccttgcggtccttgtcgatgcgccagtagcccgactcggactccagcgggcgcaccttgttgccttcggcgtcgaggacccaggtgtgggaggtgtactccaggaagtcccggccgtcgtggctgaagacgacctcctggccgaagttgcacttctcctcaccggggaagtcgaagactcccgcaccctcccagttgccgaggaggaaggcgagggggacgaggcccgggttcaggtcggacgggatctggatcatgaatggctgctcaggcgatctgtcggaggggttccggggcggtctgctgggcggatgctcagcgctgaccctggtacagcttcttgacggccaggccggtgaaggccaggacgccgacgcagaccaggaccagcagggaggtgaagactgcctcaagcacggggtgctcctcggaattcgttcagggggtacgggccggttcccaagcgtactggcccggggccgggcgcaccgtgtgaggtggcccgtaccccggccgcgggcccggatccgggctgcggtcagctcagcagctggctctgcaggatcaccgactggtggaaggggacggaggccacctcgcccttgcgggtctggatgaccatgcccaggacatcacccgtccggaggcacccgagcttggtctgctcgtccccgaggacgggcttcacctcctggtacacgctgagctcggtgccgtcgaaattggccgctcccgggaagtccagcgtggtgctgttcatctgcgtgttcttggccttgctccagacgtcgtccaggtccagtgccgacacaccggtcagctgcgtgttgaagtcacatcccttgaaggcgtccacgaagcccgaggagtggaagcgcagcaggtacacgtgcgtgcgcgtgccgtccgccgtcgtccagccccggcctgcgatctgccgcagcccttcccattcgagggtctgcttcagcttgtcgcgggcctcgggcgtgtactcctccaggaaggtgtcgaccgacaccgtcccctccttgtccgccttgaccgcgtcgtccgccttggcgcccacgggagcgggcagcagcaggccggtgaggggcgcgtagtgcgtcccgtccttgttgtccgggccctggggcagcggggcaccggcgggcagcgcgggctgggacagcgtggggaacgtccagcggccgtcgtcctcggtggacaggcccggcaggtcggtgcgctcgggctgcgtgatcccgtacgcgacccccgcgccgacggtggcgaagacgacgacggcggcggtccagcgcagggcggcgaacagcctgcgccggtccttgggcggggccggcacggcttcggcggcctcgggaacggactccgtggccgcctccggggcgggcgcggcctccggggtggatgcggactccggagcggcctcgggagtggcctcgggagtggacgcggactccggagcggcctcggtcacggcctcggtggcggtcgtgttctgctcgctcacgcggactctccgggggacttgaggtggtcgagttgctgcttgaacaggcccgcggcgtccttcaccgcgaagcccttggacccgtacatccggaaggtcaccagtacgtccccctccacggccacgcagtcgagggcgtcgatcttcttcttgtcgccctccccgccgctgagctggtccagcccgcacttggcctgggcgtagccgtcgacctggggcgcctcgccgcccgccgcggtgagctcgatgagcttcttggcgaactcaccgaacttggcgagctgctgcggatcggcctggacgagctggatctcggcgatggcggtgccggacccctcgcccctggcgtagctgcggcccgccaggcccttgagcttcaggtcggccagcatcttgtcccgctctgcgcgctcgctgctggagagacccgtacgggcgtccttgaaactctgcagcgccttctcggtcgggacgtagtagtcgttgccctcggcgtcgatgtcggggccgggccagtactccttgggcagcggcagcagcttgcccgtcagttcgttgggcggtaccggcggaatcgggggctgcgtgccctgcgtcgtgtggtcctcggccagccagtaccgcgtcggcgcggtgcggtcggcgtcgccgagcgccgcggcggcccaaaggccggagcccgcgagggcgacgacacccacggccgccgccaccagcacggccaccctgcggttcaccttgcgcacgggcccggcggtggcgggctgctcctgctcgggccgggcgacgaccggcacctcggcctcggcggcttcggcctcggggtcggtcacgttccgctgctcgctcacagccgctccatctgtcgcttggccagctcgaccagtgccttctcgtcgacgtctccgcggttgttcgtccactcgacgctcatcacggtgtcgccgcggcggaccaggacacggccctggcgcatcgggtggtagccgggcttctgccgcgcttcggagtcgatccacatgcggccgaagtccgccgggacacccgggaactccttgcccgtgttgcccgcgtgcttcgcgtcgggcatgtagtccaggacgcccgagtagaagtcctcggctccgtggcggtcgcggaactggagcaggtggatctcgacgaagtccctgccgtcctcggcccaccgcgcggtggcgatgcgcttgatctgccggccgagcccgccgagcccgccggcgggctcaaggaagtagtccgcggagaacgcgtccggggacacaggaccggagaagccgtcctgtacgccgccgggcacctccaccagcttcttggccaggtcgtcgtccgccttgtgccagcggttggcgttgatcgaacgcctgctggtcgagtggttcatggccgccggctccggcgcggccatcttctgctgggccagcggcggcagcggggtcggctcgcggtggtactgaacggcgtagccggtgaccgtcccggcgaggacgccgagcgcggccgcgcccgcgatcaggaaggccgtgcgccccacccggcggcgcgggaccgaagtgtccggctccggtgcactctccccctctttccgctgctccgggatggtctgttcgtgttccaaaggggtcccccacaggactgcaggcacggattggttacccgcgcgtaccccttgacccacacctgcggggagcagttgtacgaacgtagatcacgttctcgtctcgtgaggtttcagtcctcgtgacgccgctttccgtccagttcgtcccaccactcgtcggacttcggatcgcccgaggggtcgtcccaccagcggtcgtccgggccgcgccggttggcgatcatcgcggcgaccggcgggatgaccatggcgaccacgcacatggccaccgccgcctccaccgagaacaggcgcacgaaggcccaggcggacacgaagaggagcaagcatccgcccatgagcaggaagtagacgcgccggcgccgggcgtacatgcctccagcgtaggtccggcgcccccgcgcgcaagggcacggacggacgcggacggacgcggacggcacgaagggccgcaccccgtcccagtggcgtccaacccccgggggtgcggcccttcggccgttcgatcaggcgatcacatgtgcggtgctcagaccgcgatcgccacgtccgtcacgccgccggcttcggcgacgaccacggcacggtccgcctgggcacccgggacgagcgcccgcagcgtccaggagccggtggccgcgtagaagcggaactggccggtcgccgaggtcgggacctccgcggtgaactcaccggtcgagtccagcaggcggacgtagccggacaccggctcgccgtccttggtgatctggccctggatggcggtctcaccgggcttcagcgtcgcgaggtcgggcccgccgatctgtgctccacacatgttctctgtcctgtcctagagaggtcgtactacgagggcgtcgcgtgcccggtcgtccggtctggttacttgttggcgccgagctcgatcggcacgccgacgagcgagccgtactcggtccacgaaccgtcgtagttcttgacgttctcctggcccaggagctcgtgcagcacgaaccacgtgagcgcggagcgctcaccgatgcggcagtaggcgatggtgtccttcgccaggtcgacctgctccgcctggtagagggcggtcagctcgtcgtccgacttgaaggtgccgtcgtcgttggcgttcttcgaccacgggatgttgcgggcgctcggcacgtggccggggcgctgcgactgctcctgcgggaggtgcgccggggcgagcagcttgccggagaactcgtcgggcgaacggacgtcgaccaggttcagggagccgatcgcggccacgacgtcgtcgcggaaggcgcggatggaggtgtcctgggccttggccttgtactgggtggccgggcggttcgggacgtccttgccgtcgaccaggtcgcgggagtcgagctcccacttcttgcggccgccgtcgaggagcttcacgtcctggtggccgtagagcttgaagtaccagtaggcgtaggacgcgaaccagttgttgttgccgccgtagaggacgacggtgtcgtcgttggagatgcccttggcggagaggagcttctcgaagccctcctggtccacgaagtcgcggcggaccgggtcctggaggtcgctcttccagtcgatccggacggcgttggtgatgtggttcttgtcgtacgcggacgtgtcctcgtccacctcgacgatgacgacattctcgtcgttcaggtgggcctcgacccagtcggcgtctacaaggacgtcgctgcggctcatggtgttctcctccggggcagtgtgcggcggggcggtgcgggtgacgcgtgtgctgcgtgcctgcgggtgcgctcaaggtcctgcgcggggaggcgtcaggcgttcaggaggctggtgcggtcacgcgggaagggccgtagggccgtcgtccggtcggtggagcggatgcgctcacaggtcacatggatcgacagagcatggcggcgacgcgacacaggtctactgcccgtcgcttcgtgaggtccgcctgctgatgcttcatagccatggatcgtagggacgaatcagccgccctgtcaccggcgtgtcatataccgagacaggatcgtccgaatagtgggatgagaagcctccgaggcggccgccgcaccgcccccggacccgccgtgcggcccgtccttctgcggatcggaccgcactgtctcacgatccggccaccacgacgttcgtaccgcccagcgtgaggtgcacaccggcctcgtccgaggtcagggaggagagctgcagcccggccggcatgccgctgctgagatcgcggtcgaagtccgtcttcttgcggatcaacttctcgaccagcggaacgcccgcgccgggcacctggtcggcgtgcacgcggacgatcttgccgcccttcccgccgggtgcctcctccagggtgaccgtcgacaccacgctgtgcgtcagggccttgccggcgacctccacggccgcggtgaccttcaccttgcccggcgccccgccgtaggagagggtcgcgccggtctgggaggccgccgtcaggtcggcgtaggtgatgagcgcgctgccctcggcccggtcggcggtgccaccgctgtagtcaccgttcagcttcacgccgtggaagctcgcgtccagctccgagagccgcgtcttgcggtcctcggcggtgacctccacgccccgcagcttcaggtcgacccggtcgaggtcacggctgagcacctgggtcaggaaggggaagccgtggacctccacctccgcggaaccggccaggccctgccgcgcctgtattcggtcggccagccggttctcgacgtaactcgcggcccagcggtccacccccacgaacagggcccccagaaccactccgatgatcacgatcacgcgcaggaaacgcacgttccctccccctactaatcggtacgtgcgctctagttgaccatgcccgccgtcgggcagggatcagcccaccacccggccgatcaggtacacggcgggagcggccgccgcgagcggcagggcgacgccggccgtcatgtgcacgaacttcgacgggtagtcgtacgccgccacgcgcagcccgaccagcgcgcacaccccggcggcgaggccgatcagcgccccgcccgtaccgaccggggtcatcccgccgatcgcgataccggcgccggcggccgcggccagcgagacgccgaccgagggggcggtgggcagcggcagcgcacgggcgaagacggcgaccgcgacggccgcggcgccgaccgtggcggccgcggaatcggccgcgaggtagccggcgcagatgatggcgagggcggccgaggccaccgaggccatcagcccgtacatccgctcgtcggggtcggcgtggctgcgcagctgcaggacgagcgtgagcagcacccaggcgccgagggtcccgacgatcgcaccggggccgtacgaggggtccacggcgagcacggccgcgtcggcgaccagcgctccggcgaaggcgagggcgatgccctggcgggcgggccacatgccgttgaggcggaaccagccggccgccgtgaggccctggagggcgatcagcggcaggagcagggcgtactgcccgagggcggcggccacggcgagcagcagcccgaggacggcggtcagtatggcggactgcgggccggggtcgatgatcggcgaccggccctcggcgcgtgcctgggcggggtcgacggcgcgcagggtgttgccggagagggtgggcggggaccaggaggtgatctcctggggctcgccgggggcctcggcggccgggtccccggccgggtcggccgccgcctggggcggcaggtaggcggtctgctcgaccggcggctcctgctgaggctgctggtgctgcggctcgtgctgcggctcggggcccgggtacggcggcaggtaggccgtctcggcggcaccctgcggccagtcctgcacaggggccgcggcgggggccggggcctgcggttcgtcccggaaccagccctccggagccaccggcggctggtactgcggctcgtgctgcggctggtgctgctgctcggggcccgggtactgcggcaggtaggccgtctcggcggcaccctgcggccagtcctgcacgggggccgcggccggggcctgcggctcgtcgcggtaccagccgtccgcagccgccggttgccggtacggctccggggccgccggggcctcgtcccggaaccagccctcgggcgcgaccggctgcccgggcaccgcgcccagcggcggatgcaccggctggtagctggtgtcccaggtgtcggactgccaggtctgggtcccgcacgggtcctcctgctgcgggtcctgctggtgctgctggtgctgctggtgctgctgctgcgcgtactgccggcgctgctgttcctcaggcgtactcatcggctcccgctcacccgcccgcgaacggcgggagcacctcgacggtgcccccctcggtcagcggcacggaatcgtgcgggcgcttgcccacaggctcgtcgttcacgaggaaggagcagcgcagcaggacccgggtcagctcccccgggtgccgttcccgcacggcgtcgagcgcctcggcgagcgtgcccgccgagtacggctcctccgccgtcttggccgcggccttggccgccgcccagtagcggatggttccggttgccactgcagctcctatcgtcggctctctaccgtcggcctccatgatggcccctcccgccgctgaccccggcgtgccccgacgcgccgggtgtgcgccgggccggtccggcggcaccgatcggcggccccatgtcccgtggaacggggctcaagctgggcatccgcgtgggatgaaccacagaagtcgaaaacggaagagcctcggccgggccggggcgggtgggctattctgcttggcgagaggatccgggcaacgttgcccccgggtccttttgtgctttcagcacgttgaacgagacgagaacagtggtatccatacggaccccagggcgcggggaccgcagggacacccggcaagccgtacgaagcagtaccgcgcacgtcctcgacgggaccgaggaggaaccgacgtgatggaccagcgaaccgtgcaccaccgtccgacccgggcaggtggtcggtcgtgagctcactcctgctgctcaccaacgccctgcagccgtccgccgaggtactgcccgccctcggcctgctgctgcacaacgtccgggtggccccggccgagggccccgccctggtggacaccccgggagccgatgtcatcctcgtggacggccgccgcgacctgccgcaggtgcggtcgctgtgccagctgctccgctccaccggacccggctgtccgctgatcctggtcgtcaccgagggcggcctggcggccgtcaccgccgactggggcatcgacgacgtcctcctggacaccgccggcccggccgaggtcgaggcgcggctgcgcctggccaccggccgtcagcagctgggctcggacgactccccgatggagatccgcaacggcgacctgtcggtggacgaggccacgtactccgccaagctcaaggggcgggtgctggacctcaccttcaaggagttcgagctgctcaagtacctcgcccagcacccgggccgggtcttcacccgcgcccagctgctgcaggaggtgtggggctacgactacttcggcggcacccggaccgtcgacgtgcacgtacggcggctgcgcgccaagctcggccccgagcacgagtccctgatcggcacggtccgcaacgtcggctaccgcttcgtcacgccggagaaggtcgagcgggcggcggcggaggccgcggcccaggcggcggcccaggccgcgtcccggaccgccgcgcagacggccgcgcagccggctccggccgtcacccgatcggccgaagaccctgtgagcatccactcggccggacgccctgcccagaggtaggtcaccccgcgtagactgccgcgcgtggccaaggtgacgcgggatgacgttgcacgacttgcgggtacgtctaccgccgtcgtgagctacgtcatcaacaacggaccccggccggtcgccccggccacgcgcgagcgtgtcctcgccgcgatcaaggacctgggctaccgcccggaccgggtcgcccaggcgatggcttcgcggcgcaccgacctcataggcatgatcgtcccggacgcccggcagccgttcttcgcggagatggcgcacgcggtcgaacaggccgcagccgagcgcgggaagatggtgctggtcggcaactccgactaccgcaccgagcgcgaggtccactacctgcgggccttcctcggcatgcgggtgtcgggcctgatcctggtcagccagggcatgagcgagcaggccgccagcgagatcgaggcctgggacgcccgggtggtgctgctgcacgaacgcccggaggcgatcgacgacgtcgcggtcgtcacggacgacgtcggcggcgcccagctcgccacccggcacctgctggagcacgggcacgagtacgtcgcctgcatcggcggcatcgagaacaccccctccgtcggcgacccggtcgccgaccacgtcgagggctggcgccgggccatgcaggagtccggccgctcggtcgagggccggctcatcgaggccccgtacaaccgctacgacgcgtacaaggtcgccctggaggtcctggcgcggcccgaccggccgacggccatcttctgcgccacggacgaccaggcgatcggtgtgctgcgcgccgcgcgcgagctgcgcatcgacgtgcccggggaactggccgtcgcgggcttcgacgacgtcaaggaagccgccctcaccgacccgccgctgaccacgatcgcctcggaccgcccggcgatggcccgcgcggccgtggacctggtcctggacgacggcctgcgcgtggcaggctcccgacgggaacggctgaagcagttcccgtcggctctggtgatccgccgctcctgcggctgtcgctgacgccggacgcgggtcacgcgtccagcgtgcacggcatcagcagcgagaaggcgtcctcggtgtcggagcgcaggagcacgagcggggccttggggccgacgtactccagcagcatgtcgtcgccgacggcgagcgcgtcgaggaggaagcccgggttgaccccgacccggtccccgtcgacgccgtagccggaaccggaccctgcgtcggatgccgcgtcggaggcctcgtcggcgacggtcacggtgtccgtcaggacgagggcgcacctttcgccgtcctgcccgccgagggcctcccgcagggccggtacgtccagcgggatgcggcggccctcggggagccgcgtcaggcggcggtagtcggggaactcctcacccaggccctgtccggccacccggcggccctgcgtctccagctcgacccggtcgccgtcgacggtgagccgggccggggagtcgtcggtgagcacggcccgcatggcgtcggcgagcggtgcgggcacggccagctggacccgctcgccgccgtggccggcggtggacgcgcgggccacggccatccggtagcggtcggtggccacgaggtgcaggtccgtcccctgcacgtcgaagaggatcccgccgagcaccggcagctcggggtcggtcccgacggcgaagcgtacggagtccagcgcggccgcgagctccatggcgggcacggtcagccgggtggtgggggcggtggtggtggtcatgcttctctccttgtgtccgagtcgcgcgcgtaccgcggagagcgcgccgcgcgcatcggcgagctcgcgttcgagccgtcgcaggtgcccgtccagcagccggggcaccaggccggtgtccccgccggaccaggccgccaggaccagccggatgtccgcgagcggcatccccgcctggcggagccgggccagcagccgggcctcgtcgagctgttcgggcgcgtaccagcggtatccggtcgccggatccacccgggcgggcggcaggacgcccgcccggtcgtagaagcgcagcgcgctcacgcccagcccgctgtcgcggcccatctcgccaatgctgtgcatctcgctctccacacccgtgactctgggacctccaccaggtcgagggtcaaggccggttctcatgcgcgtcgtacgcggttctgtcgggcttctcaggcctgactcaggaagctctcatgatcggcggtcagagtcgtcgtcatgaccgacagcttccgccgcgaaggcgagtacccgcaggagaacagcccggccccgcacgcgccgttcggcgcgtaccccgcggccggggcaggggcggcggcctacccgccgccgccctcgtacccgcccgccgcacccggctggcacgaggcgcaccagccgcagccgcaggtcatccggggcgagacggtcccggcgggcgcgggcggcgcgggcgaaggcggcgggtacgagggcggcgggtacgagggcagcgggtctcacggtcccgcgcacgccgcggctcccgcgccccgcgccaagcggcccgtggccctgctcgccgctgtggcgctcgccgcggccctggtcggcggcggcaccgcggcggccgtccagcagctgatggaccggcaggcgggcagcaccggcggggtcgacggcaccacggtctcgcagtccagctccggcaccgtcgccggagtcgccgagcaggtcagcccctcggtcgtccggatcgacgtccgcaccggctccggccagggcaccggctccggcatcgtcctgacctccggcggcgagatcgtcaccaacaaccacgtggtgagcggcgccgccgagatccaggtgacgatgagcgacggcaagaagtaccccgccaagatcgtgggcaccgaccccgacaaggacctggccctgatcaagctccagggcgcctccgggctgaagcccgccgtgctcggcgactccggcggcgtcaaggtcggtgaccaggtcgtcgccatcggctcccccgacggcctcaccggcaccgtcaccagcggcatcgtctccgcgctgaaccgcgaggtgaaggtgccgaagtcggagcagcagtccccgcagggccggcagcagggcgaggacagctggcccttctccttcggcggccgccagttcaacggggacaccggctccgacaccacctcgtacaaggccctccagacggacgcctccctcaaccccggcaactccggcggcgccctcgtcgacatgaacggccggatcgtgggcatgccctcggcgatctactcccccgcctccggcaactccgccgccggcagcgtcggcctcggcttcgccatcccggtcgacacgatcaaggccgacctggactccctgcgcaagggcggccccggcggtgcgggctcctccggcacggacaccggctccggatccggctccgccgccaacggcttcggcaccagcttctgacgcacccgtgcgaggctggaggcgccgccgccacgtgccgcaccccacggccgaccaccacttccgggagacccatccatgaaccccgccgaaggcgaagcgcggatcctcgtcgtcgacgacgaaccggccgtacgcgaggccctgcgccgcagtctcgccttcgaggggtacgccgtgcagaccgccgtcgacgggctcgacgccctcgacaaggcggcctcgtactcccccgacctgatcgtcctggacatccagatgccccggatggacgggctgacggccgcccgccggctgcggtcctccggcagccgcacaccggtcctgatgctcaccgcccgcgacaccgtcggcgaccgcgtcaccggcctcgacgcgggtgccgacgactacctcgtcaagccgttcgagctcgacgagctcttcgcccgcgtccgcgccctgctgcgccgcagctcctacgcggccccgcaggccaccggcgagagccacgaggacaccctgaccttcggcgacctgcgcatggacctcgtgacccgcgaggtcacccgggccgggcggccggtggagctgacccggaccgagttcacgctgctggagatgttcctcgcgcacccgcgccaggtcctgacccgcgagcagatcctcaagaccgtctggggcttcgacttcgagcccagttccaactccctggacgtgtacgtgatgtacctgcgccgcaagaccgaggccggcggcgagccgcgcctggtccacaccgtgcgcggggtcggctacgccctgcgcgccggcgagagcgggcccgagtgagcccggtggccagattccgcgcgatgccactgcgctcccgcctcgccctgctggtcacggtggcggtggcactcgccgtcgcagccgtggcggcggtgtcctgggtgatggtccgcagccagctccgcggccagctcgaccgctccctgatggcgacgaacgtcggcgccgagctggaccggatcgtgctccagaacaactgcctcccgccgccgcagcagccgcggcagcagaccgccgggaatctgggcgcgaccgtccagatcgtcctccccgacggccggcactgctgggtcgccgggccgaccgccctgccggtgaccgaggccgacaagcagatcgcggccggccggcgggccaagaccctgcagaccgtgacgacctccgccggcgtcgacatgcgcgtcctcacgatcccggtcgtggccccggacaccggccaggtcttcggcgtctccatcgccaaaccgctcgccgacatcgacaagccgctgtccaccctcgcctgggtgctgctcctggtctgcggcataggagcggtgggcgcgggcgcggccgggctgtgggtggcccgtacgggactgcggcccgtcgacgaactgaccgaggccgtcgagcacatcgcccgcaccgaggacctgaccgtacggatccccgacgagggcgacgacgagatcgcccgcctgtcgcggtccttcaactcgatgacggcggccctcgcctcctcccaggagcggcaggcccagctgatcgcggacgccgggcacgagctgcgcaccccgctgacctcgctgcgcaccaacatcgagctgctcgcccgcagtgaggagaccggccgggccatcccgcccgacgaccggcgggagctgctcgcctcggtcaaggcgcagatgacggagctggcctcgctgatcggcgacctgcaggagctgtcccggccggacgcggccgccccgggccggctcgcggtggtccccctgcacgagatcgccgacgccgcgctgtcccgggtccggctgcgcggtccggagctccgcttcgactcggacctgcggccctggtacgtacggggcgaggcggcggcgctggagcgggcggtggtcaacgtcctggacaacgcggtgaagttcagcccgccgggcggcacggtcgtggtgacgctgcgggcgggggagctgaccgtacgggaccacggtccgggcatcccggccgaggacctgccgtacgtcttcgagcggttctggcggtccgagtcggcccgtgccctgcccggcagcggtctgggcctgtcgatcgtggcccgtacggcggcgcgtgcgggcgggagcgccgagctgcgggcggcggccgacggcggcccgggcacggaggcggtgctccgtatcccgggggcgccgacgccaccgccctccgagccgtcagttgtgccggatcagtgaggtcaccaggccggatcgggtgttcgggaagtccatggggacgacgccgagcccggtccggcccgacatctccgcgccgtcgacgaagccgtgcacctgcgggttgagccggtcggagttccagcgcggcggcatgtacgccgcggtgctgacgtagttcacgaagagcttgccgggctgctggacggccttgcggaagtggttctcgatccggccgcgcttggcgaagggctcggtgttgtagtcgtcctggatgtcgaagacattgccgtcgccgtagcgcaggccgggcaggccgccgttgtcggcgagcaggacgaccttgccgcgggcctgtccgagggtgggcagggtgtcggcgatccggaacaggggccgccagccgcggtggtccaggtagtcgtcgaagacggcgcggaaggtggcgtcgctctccccggagtactcctgcttgacgcgcatcagcacggtctcggaggggtgcgcggcgaggaagttccagcaggcgaccaggacgtccccgaacatcaggtcctggaagaaggccgcgtggtggatggcgaaggagccgccggtgacgcggcagcgcacgtcgaggaagcggatgccggagtcgagctgctgggcgatggaggtgttctggcaggcgacgtagaggccgcccttggtggcgccggagtcgtgggtgccggggatggtcatgcgctggagggcggtggagtcgccgaggccggccatccagtcctgggtgccgagggccgccgcggaggccggggcggacgcggctcccagcccgagggccgcgcccgcggccagggccccggcgaggaaggtccgccgccccattcccgtgcccgttccggtggttccggtgaccccggtacccgtgcccgtgcccgtgcccatgccgatgcccatgcccgcccctttgccgacccggtgatggccggattatggcgtgcacacgtcagagttactacccgtcggtagtggtcagtcttcgagcagctcgaccatctcgcgcagcccccggagcagcccgcggccgtccggcgccccggccggatcggtcagggcctgcaccatcaccccgctcagcagcgcgatgtgcagcgacccgagggaccgcacgtcctcctccgtgacgtcggccaccggcaccccgcgcagcgcggcggccaccatccggcggttccggcgctgcccttccgccaggatcgcgagcagctcgggcgaggactgcgcgtgcacgaaggcctcgacggaggccagccacagccagcgcatctcgccgaagtcccggatcttgcggtcccaggtgtcggcgtagcgctccccggcggtctccccctcaccggtgagccggccggagcccgcggcccactcctccatcgcggcgaagagcgcctggttgagcagggcctcgcgcgatccgaagtggtagccgatcgcggccatgctcacctccgcggccgtggcgatgtcgcgcacggtcgagcgcagataacccttctcctccaggcagcgccgggctccggccagcaggtcctcgcgatttcccatgccgggatcgtatccaccgcaccttcttgggcgcttgcgcaagacagctgtattgcgcgcttgcccaaatgctggcagggtggagccatcggaaagatccacgggcccacgggaggcacgacgatgcgccacgagctgaagatcgacgaccggaccctctcctacatggacttcggcggccccggccgcccgctcctcgccctgcacggcggcatgtccgaggcgctcgccttcgccggcctcgccgaggccctgggcgaccggtggcgggtcatcgcccccgaccagcgcggccacggcgcgtccgaccgggcccccgactaccgccgcgagggctacgtctccgacgccgtcgccctcctcgaccacctgggcctggacgcccccgtcgccctcctcggctactccctcggcggactcaacgcctaccacctggccgcctcccaccccgaccgcttctccgcgctcatcggcgtcgacgccaccatcgagatccgcatccccaccggaccgaactggttcgacttcctcggcggcctcccctacaccgcccccacccgcgaggaactcctcgccgccgccggaccggccgcgcccttcatcgccgacgcggtacgcccgctccccgacggcagcggctggcgcctggcctaccacccccaggacatgctcgactccatccgcgcctgcgagggcgaccactgggacgcctggctcgcgagcacctgcccggccctgctggtccacggcacccgcagccgggccctcacccggaccgtggccgacgcgatgaccacccggcgcccgaagacctcgtacacgcccctcgacggcgaccacttcgtgccgttcaccgacccggaggggttccacgcggccgtcgggacgttcctggccaccctctgacccctgcgccgaccccgcgccacgggggtgcccggggaacgccgaaggggcggcgggcccatggcccgccgcccctccagggctaccgcacgcggtgttacttgacgacggtgatccggttcgccgccggcggggcgatcggggccgccgccgaggagttcttcgtcaggtaggcgttgaagcagtccaggtcggacgcgcccaccagcttgttcttgtgctccttcaggacggtgaagccgtcaccgccacccgcgaggaactcgttcatcgcgacccggtaggtcttggcggggtcgagcggcacgccgttcagcttcaccgagtccacgacgacgcggtccgcgccggccttcgtcatgtccagggtgtacgtgaagcccttcgacacctgcaggatcttcgggttcggcccgttgaccggtccgctgacctgctgctggagcgcggtgatcagctgcgcgccggtcaggtccacgatgttcatcatgttggtgaacggctggaccgtgaaggactcgccgtacgtcaccacaccgtcgccctcgtcacccgaggccttgtaggcgaggtccgagcggatgccgcccgggttcatgacggccagctgcgcgccacccttgtccgccggagcgagcgcttcgagctgcgcgtcggcgatcaggtcgccgagcggcttctcgggcgcctcggaaccgcggccggggatgtcggccgagatgaagccctgcggacggttggcgatcggggccgccagcgccttccagcggtcgatcagctcggtcatgtccggggccttcggctgctcccggcccacgatcttgttcaccggcttcggcgaggtgaccggcgtacggacgatgtccttggtctgccggtcgtaggtgagggtggtgtcggtgaacaggcggccgatggaggcggccgaggtcaccgtacgcgggttgcccgccgggtcggggatgttgcaggcgtacgcctggtgcgtgtggccggtgaccagggcgtcgaccttggagtccacgttcttggcgatgtccacgatcgcgcccgagatgccggcgccggcgcccgggacgtcgcagtcgtagttgtacgcgccgctggcgggcagaccgccctcgtggatcagcgccacgatcgacttcacgccctgcttgttcagctcggcggcgtacttgttgatcgtctcgacctcgtcgccgaacttgaggcccttgacgccctcggcggtcacgacgtccggagtgccctccagggtgacgccgatgaagccgatcttcacgtcccccttcttccagatgaaggtgggcgacatcagcggacgcttggtcttctcgtccgtgacgttggcggcgaggtactggaattcggcgccggtgaactccttgccgtactcgaagcagccctcgaccgggtggcagccgccgtaacccatgcggcgcagctcggtcttgccctcgtcgaactcgtggttgccgacgctggagacgtccaggccgatcttgttcagggcctcgatgctcggctcgtcgtggaagagcccggacagcatcgggctgccgccgatcatgtcaccggcggcggccgtgacggagtactcgtggcccttgcgggcctcgcgcaggctggtcgcgaggtactcgacaccgcccgcgggtatggccttggtggtgccgtcggcctgacgctcggtcacggtgccggaggagccctgcgggggctccagggtgccgtggaagtcgttgaacgacagcatctgtacatcgacggtccggctcttcgccgcaccgccaccactcgcggcaccggccggaagtgcggccgcgaccatcgcgccggccccggccgtgacggcgagagcggtgagggtcaaccggcgggttcggcggtgccgttgtggcgtcgctgacatttagtccccttatgtgacagcggtaagacttgggaggtccgccgaagcctaaggtcaacgcgcgtagctctaccagggggtaggggtatcgcgttggttacgcgcagaagaagcaccgaccacgcgcccgcactccacccctccccgcgacggtcgtaggctcgtgccatgactgacgcagcagcggccctggagcccggacggcagattcagaccctcgacgagctgacggaggaacaggcgctcgccgtactcgacctcatcgaggacgcggcccgtacggacggcaccaccgccgtgtccgaacagggccggctccagctgcgcggcggcccgcgcgaggggatccggcacttcctgctcaccgagggcggccggctcgccgcctacgggcaactggaggacaccgacccggtggaggccccggccgccgaactcgtcgtgcacccggccctgcgcggccgcgggcacgggcgggccatgggcacggccctgctggccgcctccggcaagcgcctgcgggtatgggcccacggcggcaagtcggccgcccggcacctggcacaggtcctcggcctgaccctcttccgcgagctgcgccagctgcgccgtccgctggccgacggggacccgctgccggagccggtgctcccgcccggggtgaccgtacggaccttcgtgcccggggccgacgacgcggcctggctcgcggcgaacgcggccgccttcgcccaccacccggagcagggctcgctgacccggcgcgacctggacgaccggatcgcgcagccgtggttcgaccccaagggcttcttcctcgcggagcgcgacggcgagctcgtcggcttccactggaccaaggtccacgcggcggagcagctgggcgaggtctacgtggtcggcgtccgcccgggcgcccagggcggcggcctcggcaaggccctgaccgcgatcggcctgcgccacctggcggcccagggtctgccgacggccatgctctacgtggacgccgacaacccggcggccctggccgtctacgcgggcctcggcttcaccacccacgaggtcgacctgatgtaccgcacggaaagctgaccgccccggccccgccggatccggccccgccgggccgaacccgccccgccggcgttcgaggcgcgggtccgggcagcggcccggcgggggcccgggggcggcgcccccgccacggcgccgcaccggcacgtgctccggcgcaccccgcacccgccgggacgcagtcgtgcaccccgccggacccgggaagccacacgccattaaccaggcattcagacgcgcttgcgactctcccccaatgcagccccgactccgactgacagccgactcttccgacgtgcctgtcctcccgcgtgcgcggaagaatggagtcatgagccaccagcccagcgcaggccccaccgaggtccccgcccagcacccgtctcacacccccgccgccgcccccggccgcgccgtcaccggagcccacgcccgcataggctccatctcggcgcaccgcccgcacgtcgacctggagcccgatctcgacgcggatctggacgcctacgacgacaaggacggcgacgagctccctccggggcgcttcctcgaccgggagcgcagctggctcgccttcaacgagcgggtgctggagctcgccgaggatccgacgacgcccctgctggagcgcgccaacttcctggcgatcttcgcgagcaacctcgacgagttcttcatggtccgcgtggccggcctcaagcggcgcatcgcgaccggagtcgccacccgttcggcctccggcctgcagccccgcgaggtgctggacctcatctggacgcgctcgcgcgagctcatggcccgccacgccgcctgcttccagcaggacatctccccggccctggccgaggagggcgtccacctgatccgctggcccgatctcaccgagaaggagcaggcccgcctcttcaccctgttccgcaaccagatcttcccggtgctgaccccgctggccgtggaccccgcgcacccgttcccgtacatctccggcctctccctcaacctggccgtcgtcgtacgcaaccccgtcagcggccaccgccacttcgcccgggtcaaggtcccgccgctcctctcccgcttcctggaggcctccccgcagcgctacgtcccgctggaggacgtcatcgccgcgcacctggaggagctgttccccggcatggaggtgctcgcgcaccacatgttccgggtgacccgcaacgaggacctggaggtcgaggaggacgacgccgagaacctgctccaggccctggagaaggagctcatgcggcgccgcttcggcccgcccgtgcgcctggaggtcgaggagtccatcgacccgggcgtactggacctgctggtccaggagctgaaggtgaacgcctccgaggtctacccgctgcccggcccgctggacctgaccgccctcttcgggatcgcctcgctggacatcccggagctgaagtacccgaagttcatcgccggcacccaccgcgacctcgccgaggtcgagtccgcgtccgcgcccgacatcttcgccgccctgcgcgagcgggacgtcctgctgcaccacccgtacgactccttctccacctcggtgcaggccttcctggagcaggcggcggccgacccggacgtcctcgccatcaagcagacgctctaccgcacctccggcgactccccgatcgtggacgccctgatcgacgccgccgactccggcaagcaggtcctcgtactcgtcgagatcaaggcccgcttcgacgagcaggccaacatcaagtgggcgcgcaagctggaggagtccggctgccacgtcgtctacggcctggtcggcctcaagacccactgcaagctgtcgctcgtcgtccgccaggagggcgagacgctgcgccgttactcgcacgtgggcaccgggaactaccaccccaagaccgcccggctctacgaggacctcggcctgctcaccgccgacccgcaggtcggcgcggacctctcggacctcttcaaccggctgtccggctactcgcgccgcgagacctaccgccggctgatggtggccccccgctcgctgcgggacggactgatagcccggatcgacaaggaggccgcccaccacaaggccggccgccccgcctacgtccggctcaagatgaactcgatcgtcgacgaggccctcatcgactcgctctaccgggccgcccaggcgggcgtgcccgtcgacatctgggtgcgcggcatctgcgcggtgcgccccggagtccccgggctctcggagaacatccgggtccgctcgatcctcggccgcttcctcgaacactcccgggtcttcgccttcggcaacggcggcgaacccgaggtgtggatcggcagcgccgacatgatgcaccgcaacctcgaccgccgtatcgaggcactggtcagggtcgccgacccggcccaccgcgcggcactggaccggatgctggaaaccgggatgtccgacgccacctcctcctggcacctgggcccggacggcgagtggacccggcacagcacggacgcggacggccagccgctgcggcacgtacaggagacgctcatagacgcccggaggcgccggcgtggctcagccaaaccatgacccgattacggcgacggcggacgcgggtgccgtgctcggcacgtacctgcgtgcgcaggccaccgctttcctgcgcgcactgcgcctgcacggtgaaagcacggcgagcggggccgacgccgccgacggaaacgacgcggcgcgcagcctgcggggggctgcgcgccgcatcagcggatccctggccaccttccgggtggtgaccgagtcctcctgggccgacgggctgcgcaccgagctggtgtggctgtcctcgacgctggccgacgagcacgcgtacgccgcccggctggcccggctgatggacgcactgcaccggctgtcggggtccccggaactgccggctccgcgcggctcggccggcgcgctgacggtgggctcggcgcgggccggcgcgctgctggagcggcagctgaccctggcccgtacgcgcgcccactcggccaccctccaggctctcggctcctcccgcttccacgcggtggccgacgcggtggcggtgctggcctcggaggtcccgctggacgcggtcgcggcccggggacgggtgtcggaggtactcgtccccctggcggccgtggccgaaacccgcctgtcggcggcggtcgcggcactgccccccgtcgacgcggcccatccgtacaacgcggaccacgacgggctctggcacgaggtacgccgcctgctccgggtccaccggtacgcgcgggaggcgctcggcgaggacgtggcgcggccggccgctgcgggcgaggccctggaccgccaccgtgacgcggccgaggccgcgaccgcctcggcgacggcggcccgcaccccgcgcatcgccccggcgacggcctacgccctcggcgtcctgcacgccgaccagcgccacgaggtcgaggcggcccgtctcgctttccagcacctctggcttccggagcccgcggtcacgccgtaacacaccacaccccgtggcgcaggtgcaccacggggtgtgtcggagccgtgtatttcggccagggcggacggccctggccgagccgggacggaagtcagccgcagaagccgccgaactccaggtcgccgtagtagccgctcacggtgtgcacaacggccttcacgcggatgcaccggcccggggcgctgatcgagatggggcccgcctgctccgcgaagttgccgacatcggaggccgactggccccctaccgcccacaggtggacttccagccgcgccctcgtaccgaattctccgaggcccgtgcggcggttcaccacacagttcttcccggtggccccgtcgtagtacaggtagacgttgctcaggttgaatccttcattccgctcggtgacggagtagctggcaatcttcttgccgggacatccgtactgcgtggcggcgctggccgtcggcgccatcgcgatcacgcctccgagcatgacgccgaggctcgcaagaaccgaaacagatctcttcagcatcctctgcatcaacccccattgccattccaggatttggacgatccgatcctcaccacggacggacagcactgtcaaacggtatatacgaccggccccattgccgccgctgtccagaattcgagtgatgccggaatttccgaaaaccgccgcccggactccgaaaccggattccacttcattacatcgacgacacccccaccactgccgctctccgattcccggggattcgaatatcctccagttgcgcggcacggagcgccctcccaggcgtaaactcgatcaccgcccgatccggcggggacggacccggggccctcgtgacacacccgcccttacgtcgaggttcaccttccgttcactcaccccggtcgatcgcttcacctgttctgcctaatttcggtgatgcacggagcgagtcgcccgcagacggagcagctcagccgcgcaccaccgatgtcctcttcgcacgccgccccgatacagaaagcggccggcggcttctggaaggaacacccgaaagtgaagcttcagcgcaagaacatgcttcgtgcctccgccctcggggcgcttgtcgtgtccggcgccctggtcctcacggcgtgcggctcggacgacaacaccaagaccgccgacggcacggcgaagccgtccgcggccgccgcgggcgacatcaagtgcgacgacgccaagggcaagctgctggcgtccggctcctccgcgcagaagaacgctatcgagctgtggatcaagaactacatggccgcctgctccggcgtcgaggtgaactacaagtcctcctcctccggtgagggcatcgtcgccttcaaccagggcggcgtcggtttcgccggctccgactccgcgctgaagccggagcaggtcgaggagtcgaagaagatctgcaccggtggccagggcatcaacctgccgatggtcggcggccccgtcgccctcggcttcaacgtcgccggcgtggacaagctgaacctggacgccgccacggtcgccaacatcttcaacgacaagatcaagaagtgggacgacgaggcgatcaagaagctgaaccccggcgtcacgctcccctccaccgccatccaggccttccaccgctccgacgactcgggcaccaccgagaacgtcaccaagtacctgaaggccaccgcccccgacgcctggccgtacgagcccgcgaagaagtggtccgctccgggtggccaggccgcctccggctcggcgcaggtcgccgcccaggtcaagcaggtcgacggtgcgatcggctacttcgagctttcgttcgccagctcgcagggcatcaagacggtggacctgaacaccggcgcctccgccccggtcaaggcctccggtgagaacgcctccaaggccatcgccgccgccaaggtcgcgggcaccggctccgacctggccctcaagctcgactacaccaccaaggccgagggcgcctacccgctcgtcctggtgacctacgaggtcgtctgcgacaagggcaacaaggccgagacgctcccgaccgtcaagtccttcctgaactacgccgcctcggacgcgggccagaaggtcctcctcgagaacggctacgccccgatcccggccgagatcaacgcgaaggtccgcgaggtcgtcaacaccctcggctgaatcctgaccccaggtccggtccgctcccccgtccgggggcggaccgggccgggaccctccccttcacccgggggaatccggtgcaccgccgccagggggcctgccccccacacagaccggaaagaccatggcttccaccacacccacccagatagacacggctccgcctgtcacccgtagcggaggatcgtccaccggccgcgccggcgacaagatcttcgccgggctctccaagggctccggcatcctgctcctggtgatcatggcgtcgatcgccgtcttcctcacctaccgcgccgcgatcgccctgtcgaagaacgaggggaacttcctcaccaccttcgactggaacgcgtcggccaacccgcccgtcttcggcatcgccgtcctgctcttcggcaccgtcgtcagctcgatcatcgcgatggccatcgcggttccgatcgctgtcggcatcgccctgttcatctcgcactacgcgccgcgcaagctggccgcgcccctcgcgtacacggtcgacctgctggccgccgtaccgtcgatcatctacggcatctggggcgccctcttcctcgtcccgcagctgaacggcctgaacctctggctcgacgagtacctgggctggacgtacgtcttcgacaagacccaggtcggcgtcgcccgctcgctcttcaccgtcggcatcctgctcgccatcatgatcctgccgatcgtgaccagcgtcagccgtgaggtcttcctgcaggtcccgcgcatgaacgaggaggccgccctggccctcggcgcaacccgctgggaggtcatccgcatgtcggtgctgcccttcggccgctccggcgtcatctccgcctcgatgctcggcctcggccgcgcgctcggcgagaccatggccgtcgcgaccgtcctctccccgagcttcctgatctccggccacatcctggacccgggcggcggcacgttcgcgcagaacatcgccgcgaagttcgacgaggccaacgagttcggccgcgacgcgctgatcgcctccggtctggtcctcttcctgctcaccctgctggtcaacggtgcagctcgcctgatcatcgctcgccgcaaggacttctcgggggcgaacgcctgatgagccacgcactccaggaccagcggcccacccgggcccacaagtccgccgctcccgccggcctcacccgcggcggcctgccccgctgggccccggccggcatcgcggccctctcgatcgccctcggctgcggcatcggcctcgtcttcggcctccacagcaagatccagtggggtctgatcgcgtccctgctcttcgtcgccgtcacgtacaccgcgagcgcggtcgtcgagaaccgccgccaggccaaggaccgcgtcgcgaccgccctcgtatgggtctgcttcgtcctcgcggtcatcccgctgctctcgctgatgtggaccaccatcagccgcggtctggaactcctgagcgggaacttcctcagccactccatgaacggcgtgaccagcttcgacgagggcggcggcgtctaccacgccctgctcggcaccatcgagcaggtcgctctcgccacgctgatcgcggcccccatcggcctgctgaccgccgtctacctggtcgagtacggcaagggcaccctggccaggtccgtcaccttcttcgtcgacgtgatgaccggcatcccctccatcgtcgcgggcctgttcatcctgacgacctggaacctgatgctcggcttcggcccgtccggcttcgccggcgcgatggccctgtcgatcctgatgatgccggtcgtggtccgctccaccgaggagatgctcaagctcgtcccgaacgagctgcgcgaggccgccctcgccctcggtgtgccgaagtggcgcgtgatcctcaaggtcgtgctcccgaccgccatcggcggtatctccaccggcgtgatgctggccgtcgcccgcatcgccggcgagaccgccccgatcatgctgctggtcttcggtacccagctgatcaacggcaaccccttcgaaggcgcccagtcctcgctcccgctctacatttgggagcagtacaaggtcggcagtgaaccctcctacgaccgggcatgggccgcagcgctcgtcctgatcgccttcgtcatgatcctcaatctggtggcccgcggcatcgcccgctggaaggccccgaagaccggtcgctgacgcgactcatgaaagcgaagtgacccctcatggcgaagcgaatcgacgtctccggactgtccgccttctacggcagccacaaggccatcgacgacatctcgatgaccgtggagccccgctccgtgacggccttcatcggcccctccggctgcggcaagtccaccttcctgcgcaccctcaaccgcatgcacgaggtcacccccggcggccgcgtcgagggcaaggtcctgctggacgacgagaacctgtacggcaccggagtggaccccgtcgcggtccgccgcacggtcggcatggtcttccagcgcccgaaccccttccccaccatgtcgatcttcgacaacgtggcggcgggcctgcggctgaacggcagcttcaagaagtccgagctcacggacatagtcgagaagtcgctccagggcgccaacctctggaacgaggtcaaggaccgcctcaacaagcccggctccggcctctccggcggccagcagcagcgtctgtgcatcgcccgcgccatcgcggtcgagccccaggtcctgctgatggacgagccctgctcggccctcgacccgatctccacgctggcgatcgaggacctgatcggcgagctcaaggagcgcttcacgatcgtcatcgtgacgcacaacatgcagcaggcggcccgcgtatcggaccgcaccgccttcttcaacctctcggccgtcggccagcccggcaagctcatcgagctcgacgacacggaccggatcttctccaacccgtccgtccaggcgaccgaggactacatctcgggtcgcttcggctaaaccgggaccgcgcgtcctgcggtgctgcatggcggtgccaccgcaaggcgaaagaaaaagggccggctccccctgggtggggggagccggcccgctttcgtccgtggactccgcgcagcgcggggctagacgaacgccaggtccacgatccagaagcacagcgcggccaccagggccgccgccggcatcgtgatgaaccagccgaggacgatgttcttggcgacgccccagcggaccgcgttcacacgcttggtcgcgcccacacccatgatcgccgaggtgatcacgtgggtggtggagatcggcgcgtggaagaggaacgccgagccgaacatgatcgaggcgcccgtggtctcggccgcgaagccctgcggcgggtccagttcgatgatcttgcggccgagggtacgcatgatgcgccagccacccgcgtacgtacccagcgacagcatcacggcgcacacgaccttgacccagaccgggatcgcctcgtcggcggtctgcacatcggcgatgaccagggccatcacgacgatgcccatcgtcttctgcgcgtcctggagaccgtggccgagcgccatggccgccgccgacaccgtctgcgcgatacggaagccgtgcttggccttgtgcgggttggaccggcggaacatccacaggatggccaccatcaccaggtaaccgacgaccagaccgacgaccggcgagacgaacatcgggatgacgaccttgtcgaggacgcccgaccagatcacctcggtaccaccggccagcgccgcgcccaccatgccgccgaagagcgcgtgcgaggaggacgagggcaggccgaagtaccaggtgatcaggttccagacgatcgcgccgaccagcgccgcgaagaggatccacatgcccgtggcgcccgtgggcgtctcgatcagaccctggctgaccgtcttggccacgccgctgcccaggaaggcaccggcgaggttcatcacggcggccatcgccagggccgcgcgcggggtcagcgcccgcgtggagacggacgtcgcgatcgcgttcgcggagtcgtgaaaaccgttcgtataggtaaaaccgagcgcgacaccgatggtcacgaccagagcgaaggtgtccacgaggttcaggactccttgaccgcgatggtctccaccgtgttcgcaacgtgctcgaacgcgtcggccgcctcttcgagcacgtcgacgatctgcttgagcttcagcacctcgatggcgtcgtacttgccgttgaagagctgggcgagcagcttgcggtggatctggtcggcctggttctcaaggcggttgacctcgatccagtactcggtgaggttgtccatcgtccgcaggtgcggcatggcctcggcggtcagctcggccgcccgcgccaggacctcgatctgctgctcgacacccttggggagctcctccacgttgtagaggacgacgaggtcgacggcctcctccatgaagtccatgatgtcgtcgagcgacgaggccaggttgtagatgtcctcgcggtcgaacggcgtgatgaaggaggagttcagctggtggaagatcgcgtgagtggcgtcgtcccccgcgtgctccgctgcccgcatccgctccgcgatctcggcccgggcggaggagtccgctccgagcagttccatcaggagcttggagcccgtgacgatgttgtccgcggatgcggcgaacatgtcgtagaagctcgtctccctgggggtcagacgaaatcgcacgtgaggtcctcggggtgcattggattcggtcaggctgatgctaggcgcatcccccggccacggctaaccggccgttccccagtgtcctccatcgggcagagtgaggaccacggacccctgccccgggcggcggggcccagtaccctatacccatgaggggtatgcgttcgcatgcacccctcgttccggaccacgggaggaccgtatgacgaccatcgaggcggaaggctccggagccgtctacggctaccaccaccagaaggacgagcacctcaagcggctgcgccggatcgagggccagatccgcggcctccagcggctcgtcgacgaggacgtctactgcatcgacatactcacccaggtctccgcgagcacgaaggcactgcagtccttcgcgctccagctgctggaggaacacctgcggcactgcgtcgccgacgccgcggtcaagggcggcaccgagatcgacgccaaggtcgaggaagccacgaaggccatcgcccgcctcctccgcacctgaccccacacccccggccccgccggcgttcgaggcgcggggtctggggcggagccccggcagcggcgcggcaggaaggccgacgaccccgccaggcccgaccccagccgggaggcgaccggctaccgcccgagcaggacctcgtcgatccggtccagactgagccgctcctcgaccgccgccgaggcggcgatgatcagctcaccgcacagctcgatctcggcgagagcaacgtggtcctgcaccgtcgtaccgcctgcgggagtcacgcgtgtcacctcaatctgccaccggccaccggccgtcatcggtcataccgcaccgcaccacgcgccggcgcccggcttctcagcgtagggagcccgtgccgtcccccgcatgacacggatggaccatttccggataccgggccatggcccgatcgcgtcgcccgtccctcgcccgccccactagtcggcgatcttcccggcgtaaatgtccccgtttgcgggcaaaacaacggtcaccggcgtcccgaacccgtacagcagcgtggtcgacgacacatcgatcacgccattgttgacgtacgtgaaccggtgcctgaccttccgcaggcgcccttcctcgtccaggtaggcgtcgaacggcaccgtgtccgtgctgaaccctttcgccgccgccgccagcgccccccgcgtctccggtgacgcgctccccgccgcccgcccgatgtccgtggtcccccggtagtgccgcaccctggtgcccgccacctcggtctcccccacgtacgtcacctcctgcgcgccgcgcagcagctcggccgcgaccagcggatcggtggccccgcccgtgaccaagttcccgtcgttcagggtcgtcgtgtcgacccgtacccacttgtcgtccgggacgcccgcgccccggttcttcatgtagagcgcgcccggcacgagcagctcggtgatgggccggtgctcggccttgcccttcacgtcggccgggagcatcacaaggagctggcccatccgcttcttgaagtcgacgccgccctcaccgcggatcgtgacccgggtgcctcccgtggccatctccatggccgtacgggcccgggcgctgccggtcctcgccagtgcgtcggcggccccgcggaccaccgccgccgggtccgccggagcccggccgtcgctcgcgtcgcccgcgcacccggccatcgtcgtgaccgccagggtgacgccgacggcgagcaccgcctcacccgcacgcccgcgcggtcgcctgtgctggtgatccaccatcgcctgccaacccccaacgcatgaccgctgcttgcccgaggcccccacccgctccgcttaacgaggtccggggtttcccgtcacgggggcgcaccctccccgcgcgccgcccgtcccggtaccgtggacgtgtggaaccgcacaccgaagcgaccctggtccctccgcttgattccctgccgctcccgcggccgcacgcacagccggagccaccgaccagccacaccacatccaccgccgagcgcggatcgttctgcctggccgtctgcacgtgcggctggagcggtccggcccgccgctcccgcgacctggcccgcaaggacgccacccgccacacggcggcctagggggtgtctttcggatcgtggcccggcacgatccgaaagagacggcctcgcccgttcggacggcccggctggccggggcacgccgcagcggatgcccttgactcatgccaggttccgcagcccgcctcgcgaccctcctctgggccctgctcatcgtgtccgccccggccgccgcggcctgggccgggcccgtgggctcggcggaccaccccgccgacgtggccctggccatcgggctcacctcggccgcggcggcggcgacgggctggtggctgcggtcccggtaccgccgcgaggccgacggcggtgatccctgatgccctggagccgtacccgcacccgtacccggccgcgctcgcggccgaaggcggtacggatgtgcttcggggcggcggtgctgtgcctgctggcggccgcgctgctcgccgtatggaactcgtacgcgcagagctgagagccgagagccgatggtcccgcgcccgcaccgccaccgcggtgtcaggcggcgaggtcgctctcgtgcgcgggcggggtctgcgcctgcggcaggccgacgggccggggcagcgcggggttcttggatcgtacgagccggccggcgcgccgggagcgggccaccgcccgcaccatccgggtcagcacggccatcgcgagcggcgcgagcatgagcaccacggcggtgccgagcgcgaggccgccgatgacgtcggtcgggtagtggatgcccatgtacacccggcacaggccttcggcgaacgccagcccgatccccaggaggccgtacttccggttcgccacgaacaggcctacgcccagggccatcgcgagggtggtgtggccgctgacgaaggagaactcggtgcgtccgagcccccagccgaagccggggtcgagcacgtgcaggccctcgtgctgacggaacggcctcggccgcccgacgaattcacgcagcggcacattcacgagcagcgccagcccggcggccagcggggcccagacgagcccggcgcaggtctcgacggcggtggcctcgtcctgccggcgggcgccgcgccagcaccacaggaccaggagcaccagggccagcaggatcccgtactccccggcgaagcccacgacccggtccagccaggccggagcgtgccgggccgctccgttgatctcgtacagcaggctgacatccacgttcggcccacctgttgtgagtccagccatggtgatgcggccccttgcccttgccgtggttctcctgtgggacgcacccctgtgtgcgcccctccacccccacttgatcaacccccgcgcccatggaacgcccgttctggctcctacgttccattctccacggaatgatcactccaacgttatcgaagagtgactcatcgtcgcagctcagggcctttacttcacggagagttgctatgcgggccgacctgcggcggagcggtccggaagggcttccgcaccgtccttggtcacgcgcgtcgcgccgaagtagtccggggtgtcgatcttgtcgaaccggatcacggcaccggtgtaaggggcgttgatcatgtacccgccacccacgtagagcccgacgtgccggatctcccgggaattcgtcagatcgtcggagaagaagaccaggtctccgggcaggagttgatcgcgcgaaggatgcggcccggcgttgtactggtcgttcgccacgcgcggcaactcgatcccgacggtctcgtacgcggccttggtcaatccggaacagtcgaaccgcccgtcctgatcgggcgtcccgtttccaccccacagatacggcgtccccagctgcttctgcgcgaagtagatcgccccggcagcctgttgcgagggcgccacccgcccgacgggccgcgcgaagctcttctccagggcccggatggacttcacatagccctgcgtctcgctgatcggaggcacgcccccggccttgatcacgcggtagggcccggcgttgtaggcggcgagcatattgtcggaacgatccccgggaacttgggcgacgtccttggcgagttggcagtcgtacgaagcggccgaagggatggcgtccttggggtcccagatgtcacgatcgccgtcaccgtcgccgtcgatgccgtacgtggcccaggtaccggggatgaactgggcgataccgcgcgcgtcggcgtgactcaccacgtcgggcttccagccgctctcggtgtagagctgcgctgccagcagagccgggttgagagcggggcagaggtttccccacttctccaccagcggctgatagatcgccggcaccgaccccttgaccagtccgacggcaccctgcctgccgctgttcgcgatccccgccgccgccgagtacgtgccgacgacgagcagcgccacgaaggtcaggcacacaccgatcccgagcccgcttgccatccagaacttgcgcactcgtcaacactgcctcatggaacgtcacctgacagtggattcgtcggccagacccggcactatttcaccggaaagccggtgcagtagatggagctgtactccttgacgccccggacccggtagaccagcacggtccagtcaccgggatcgttggcgagcgggatggccggaaacttcttcgtggtcccctcgttgtccaccagttgcgtggcgaagtcgtccggatacgtgagctccacgtcgccgcccgtcgcctggtccttgagatcgacgggcttgctggtgtaaccgatgccgtggttgtagtcgcggacgaagtcgtacggacgctgggtgctctcgtcgatctcgtgcggagccttgaccccgacggagacggcgtagggacccttctccgtgttgtacggcttcaggtagacgtggatcttgaccttgcccgtgaccgtcttcgccgccgggtcgtcggcgtcgaccacggaacccaccaggaactccgcccgctcctccgcgggcaggctgcagcccccgccgcccggaccaccactggtccacaggtcccgcgacaccttgttcggctcgatgtggtccggcacggaccccgacccgccggagccgccctgggaggagggcggggggctcgacgcgggccggccggaaccggacggcccggccgggacgccgggtgtggcctgagcgctcgccgtgccgccggccggcggcgctcccgcggccaccttgccgtccttgccgtcctcgtccttgaggaagaggtacccgcccgtgacgaggccgcccgccaccagaccgctcacggccgccagcgcccagcgcggcacccgcgccccgccggtgccctgcccctggttgtggtcctggttctgcccctggacctggacctggccctggccctggccggcgggtacgtacgtcggcacgtagccggccggcagccccggaccgatggtggacggcagtcccggcacctgcgcggccccgcccgcggtcgccgtcagcgccgcgtacaccgggtcgtcgaccagcgccgagtccaccgcgcaacgccggatgatctcggcgagcacgggccggtcccccggttgggccgccacgcaggacgtgacgagcgcggccaggtccggctccacaccctcgatgtcgatctcgccgtggaccgcacggaagttgacggtgttcgggtcccccgtcccgtacggcgcccggccggtcgccgcgtaggcgatcgtggcgcccagcgcgaacacgtccgcggcatccgccacctctccccgcagcaggacctcgggagccgtgtagccgggagtacccggggcggtgccggcctgcgtcagagccgtctccgccacgcccttggcgatgccgaagtcgatgagctgcggaccctgcgcgcccaggatgacgttctgcggcttgaggtcccggtgcgtcaccccgtacgcgtgcacgctggccaggccctccgccagcgcggcgaacagcctgcggcacgcggcggcgggcagggggccgtacgcgcgcaccgcgtggctcagggtgggcccggccacgtactcggtggcgagccagtagggcggcgccgccagcgacgcgtcgatcaggttcgcggtgtacgcggagcgcaccgcgcggaccgtctcggcctcccggcggaacctcgcgagggcctccggatgcccggtgatctcttccttgatcaccttgatggcgaccagacgaccacccggcgaccgcccgaggtacacctgccccatgccaccggcgccgagccgggccagcagtgcctgcgctccgatgtgcgcgggatccgtgtctctcagggcctccatccgcatgagcctgccacacgcatgcccagcccctgacaagggggttgggctgtcggggcgtccgctatcgcggtgccacgaacagactctgcgcactccgcccgatggggcccttctcgtcgtgcagccgcgcgtccgcgagcccgatcccggccgcgtccacactcgtacgggcctccacgcacgcccactcgcccaccggatggcggtgcaggtggacggtcaggtcgccgttgatgaagacgtaccgcccgaagtccatcaccgagctgatcccgttccccgagtcggcggcgatcagcacccggtccagcggcctggtctcctccccggcgacgagcggcaccttcatccgcatccagcaggtgccggggcccagttcgacgaaagcgccctcggtgaaccgggtctccatggccgagtggtagccggtctcccacggcaccgggaagaacggcgtcacctccacctccccgggcggcggcagctgcggccccgggagcacggccggtacggcctcctcggccatccggatccgcagggcccgcgccagcatgacgggcgcgccgcccgccggcgcgagggccgcctcgaccacctcggtcccgcgaccggcccgcagcacactggtggtgatctccagctcgccgatcggcaccggccgcaggatctcgtacgtgatccgggcgatccgcatgtccgtacgcgcacccggccgctcctcgacggcccgccccagcagcgcggccggcggcccggcgtgctgcgagcccgggtcccacggcccccgcgtgtactcggtggccaggaaccgcccggcgtcgacccgttcgaagaacccctcgtgaccctgaccctcgtacacctcggcagcacccataccggccacgctaccgacaggtaaccccggccaccagacccctgcgaccgactcagcgggcgaaccccagccccacccccagccccaccagcaccgacccgatggcccggttcagcgccttctgcgccttcagcatccggtcgcgcagccgcggcacggagaagaacagcgccaccgccccgaaccagcccaggtgcgccgccgacatgaacagcccgtagcccgcctgctgccacaccggcgtatccgggttcaccacctgcgtgaaggtcgacaccacgaacagcgtcgtcttcggattgaggacattggtcaggaaacccgaccgcatggcccccagccgggtcagctgcggcttcgactccaggtccacggtcacctcggcccgcgcccggaaggtgcgtatcccgatccacaccagataggccgcacccgccagcttgatcacggtgaacagcgccgtggaggaggcgatcagcagaccgaccccgagcatcgtgtaggagacgtggaccagcacgccggccgcgacaccggccgcggcgaacaggccggtggggcgcccgtagaggtagctgttgcggaccaccatggcgaaatcggcgccgggactgatcacggcgaggagggtgatgacggcgactgcgatcacttctgtcatacggggatgctcaccgccaccgccccgtggatcaagcccctccggacaaccgggggcaccggcccgacaggcgacaatggacgacgtgccgagtacccccgccgcccccgcccccgccccgctccccgtcctgcaggccgactgcgcgaactgcttcgcgctctgctgcgtggccctccccttcgccaagtccaacgacttcgccgtgaacaagcccgccgggaccccctgcgccaacctccagcaggacttccgctgcggcatccacacccggctgcgcgacagcggattccagggctgcaccgtcttcgactgcttcggcgcgggacagcagacctcccaggtcaccttcggcggccgcgactggcgcacccaccccggcacggcccgccagatgttcgaggtcttcccggtactgcggcaactccacgagctgctcttctacgtcagcgaggccctgaccctgccggccgccgccccggtccacgcggacctgcgccgcgccctggcggagaccgaggagtggacccgcgccgacgcgcaggccctggccgacctggacgtcggcccgctccggcagcggatcaacaccctgctcctgaagaccagcgaactcgttcgggcgaaggtgccgggccgcaagaagaaccaccgcggagccgacctgatgggcgcccgcctctccggagccgacctccgcggcgcgaacctccgcggtgcctacctgatcgccgccgacctcacccgcgcctacctccgcacggccgacctgatcggcgcggacctgcgcgacaccgacctccgcggcgcggacctgcgcgaagccgtcttcctcacccagccccagctgaacgcggcccagggcgaccccaccacccgaatccccccgtccctcacccgccccacccactggacctgacgcacccacccgaggcgatctttcagagccccgacggcgtttgaggcgatcctcttcagccccgccggcgtttgaggcgcggggtctggggcggagccccggcaacggcgccgcacccgccccgggccgatccgcaccccccggccgccaacccaccgcactcacacccgcgccaaaaacccccgcacggcagcgaagaacccctccgggtccccgacccgcaccgcatgccccgccggcaactccaccaaccgcacccccgccctccgcaccgtcatctcccgcgcgtgctcggccgacagcaccccgctccggtccccccgcaccagcagcgtcggctgccgcacctccagccagtcgtcccagtggtccccgttcagccgccgctgggactccaccatgtcctccacgtcgaacacggtcccccacccgtccggatactcctgcagcgaccgctccagatacggcgccgcactccccacccccgccaggaacccggccctggtctcggcccgccgcggccactcccgcgtgtacgacaggtcgccgtcgaccacggccccgatgtcctcgaccaccaccgcccgcaccagatcgggccgccgcgccgcgagctggtaggcattgaccccgccgagcgaatgccccagcaccaccgccggccccagccccaactgctccagcagggcctccgcatccgccacgtacccgtcccgcgtgtactccgccgcccggtcggacctcccgtgcccccgctggtccagggcgatcacccgccacgccggacccagctcccgggccaggcgttcgaaggcccccgccccctcgtcgaagtgcccgtgcagggccagcagcggcgcacccggccccccgaagtccgtataggcgagccgccgcccgtcccgcgtcaccatcgcccccggcaacggccccagtttgtcgatgacccgctgccggagcagctggtactcctcccaccgcctgcgcagccgcccggccgggcgcttcacgatccgccccggcgtgaccgtctcgccccgccggaactgctcccgcgtcagatcaatccggatgcccccgggcatcaggttccaccagtggtagccctcctgccggccctcgtggaacacctcgcccagcatcaggtccccgcccacgaggtcctgcaccaccagcgcggtgatgtcgcagtgcccccaggccggattctccgcggtccacggaatgcgggaaatgtcggagggctcacaggtctcggccgaccatcccgcccggatggccgcctcaaggtccgcgagagtccatggagtcgtcatgctccccagcctgccgcaccccactgacaactcggccgccacactcgcgcgcaccgatgaaacgaccgaaggaccatccgacgcgtgtcggcgggtcggcccaacgacacgccacaccactgctccgaacggcggcccctcaccccaccctccgaacgccgggtcgacaaatcagtgtccggcgtcacccctcgtgatacacagagtgaccgcatgttctcgcccgcacacccgccgctgcccaggtcagagcgcggaagcgaagcgcgggccgcgagatcgggtaaagagagccgtcaagtcgacgacggcggcggtttcatcagcgaagatagtgcgtaacccctgccgtcgggcaggggcttccggaactacccgtacaggggcggtgagttacatgatcctggcagccgaaaagggcgacatcaccaccatcatcggcggaatcgccccgaactgggggcctttcggcagtctcggcaacgaagcgaaggtcatgatcgaggtggtcatggccgtcgccatcctgctctgcctgggcatcgccatctggggggcggccaaacagcgcatcggcgcgaccgccctgcgcgacacgttcagcgcggaacagggcaagggcctgatcgtggccgggctgaccggagtcttcatcatcggctccctcgggacgctgttcaccatcgtctacgggatggccgtctagccgggccgtgcgccgggccccgtagccgatgacgcatcaccacaccacatccacgcgggaaccagcgctaccgtcgtacgacgcggagggggcggacaccgaatgagcaacgacgaccagtacggcggcgccggcggctacggcggcgaggtcggcggcaccggccagacccgcacccgcctcccggactccccggccgacccgtacggcccctcccgccgcaccccgcgcacctcccgcagcctgatcaccgtggtcggcgtggtggtcctcctgatcgcggccatcgccttcgccaactccgccccggaaaccccctcggaccccgcctcggacaaacccccgacggactcctccacggcggccacgggcacgaacccggtgacgggcaaatccgcggccatccccaagggcttcgcccacgacgaacagggcgcacagtcggccgccgccaactacgcggtggcgctcggctcggacggcatgttcaagaagaacacccgccacgccctcgtcgacgggatctatgcacccgacgtggccgcccgcacgaagggcccccaggacgaggcgtattccaccgcgttcctcgccagactcggcctcgacgccaacggcaacgccccgcagggcagcaccttcgtcacccgtgccgtcccgatcggcacccgcgtcgagagctacagcccgaccaccgccaaggtcgccgtctggtacacgggcctgatcggcatgtccggccccacgtccaccgacccggtgcgcacgctctggaagacctggaccttcgaaatgagctggatcggcgatgactggaaggtcgtggacgacacccagcaggacgggcccgccccggttcccggtgatgtccccgtgtcgacgtccgacgacatgagcaaggccatcaaggaattcgggggattcacctatgcccgctaacctccggctccccgcgcggctgggcgtcgtcacctctgtccccctggcggtggtggctctcgccgcccgcgcccatgcggctccgactccgacgccgacgcccaccccttcggcgtcagccagcaacaaggactgcgagctccttttcggctcggcccgggactactgcgagaagggctccggcggggccccccgccccggtctcgcccccaccgaccccaccgacgccctcaaccccctcgcctccctcgcccgcggctgcgccgacgccgcctcctggatcgtcggcaagctcagcgaagcggtgaagggctcggccgaggtcgacttcaccaaccccgccttcctcaagcagtactccgtcgtcttcgccgcctccaccatcctcaccctcgtcctctggctcttcgccgtcgccaagcgagccgtccgcggcgtccccctcaccaccgccatgtccgaagccatcggcttcctctggctcaccgtcctcgcctccgccttcacccccctgatcctctacaccgtcgtctccgccaccgacggcgtcaccgccgtcatcgcctccgccaccggcggccagaccgacgtcttcttcggctcgttctccgaagccctcaagaagggcgacgacatcggcggcggcccgatcatgctgatcgtcgtcgcgctcgtcaccgtcctcgccgccggcgtgctctacctggagctgttcatccgggccgccctcctctacgtcggcgccctcctcggcgtcgtcgtgtactccgggctcgtcgaccgcaacctctggggccacgtccgccgctgggccggcatcatgatcgccgtcatcctcgtgaagccggtcatcgtcatcgtcctcggcctcgcgggcgccctgaccggcgagaagggccccaacgccttctccgccgtcgtcaccggcctcgcgatcatcctcctggcgatcttcgcctccgcgatgatctaccgcttcgtccccggcttcggcgacgagatcgcctccgcccgctccaaccgcagcaaggccaccgacggcgcccaggcggccgccgtcatcagctccccggcctccctcgtctcgcagggcatcaagacccacagcagccgcggcgcccaccgcggcgacggcggcagcggcggcaacaacgcgccccgccccgccaaccccatctccggaggcgtggccgcccacagcagccgacccacctccggcggcggggccggcggcggatctgtcccctccgccgcacccccgccccgcacgagttcgagtacgaggaacacaggaggtgacgggcgttgacgacccagtcccaccagctgcacccggtcgcgccccgccgcacgtatctcatcggccgcgcccggcccaacgcgatcgtcggcaagaaccgcgagaccggcgagatcgccctgatcatcgccggggcgttcttcggcatgatgagcggactgctcgtccccgacctcaccctgcgcatcgtcagcctcgccggcttccccatgatcgcgctcgccgccgtctacgtcccgtacaagggcaggaccttctaccgctggttcgagatcagccgcagctacaagcgcaccctgcgccgcggcaccacctaccgctccggcgccatggaagccggcatccgcggctccgacggccgcgaggtcgaggtcggcccgccccccggcatcggccgcatcaactggctcgccgcccccttcggccccgacgagatcgccgtcctcctccacgcggaccgccgcaccgtcaccgccgccatcgagatcgagggccccggcgtcggcctgcgcgacagcgaggaccaggaagccctcgtcgaccgcttcggcaccctcctcaagcacgtggccaacggcgacggcttcgtcacccgcctccagatgctcgcccgcaccctccccgccgaccccgacgcacacgccaaggacgtcgcccagcgcggcgacacccaggcccccggctggctccgcgactcctacgaccagctccagtcgatggtgtccacctcctccgagcagcaccgcgcctacctcgtcgcctgcatgcactacacgcgcgaactcgccgccgaggccaacgccatcgcccgcgccggcaccccccacaagggccgcaagctcgaccgcgacgccggcctcgccatcgtcatggcccgcgagctcaccgacatctgcgcccgcctcgccgaggccgacatccgcgtccgccagcccctcggccagggccgcctctcctccctcgtgcactccatgtacgacccggaccaccccatcgaccacatccaggccatgaccaagcgcaacgcctggcccgccgagctcgacgccgtggaacccaccttcctccaggccaagacccgcgagtcctccacccgcgccccctggtgccacgccaccgcctgggtcaaggaatggcccatgacccccgtcggcgtgaacttcctcgccccgctgctcgtccacacccccgacgtgatccgtacggtcgccgtcaccatggacctggagcccaccgaggtcgccatcgagcgcatgctcaccgagaagaccaacgacgaggccgacgcctcccgcgccgccaagatgaaccgcaccgtcgacccccgcgacatcgccgcccacggccggctcgaccaaagaggtgaagatctcgccagcggcgctgccggagtcaacctcgtcgggtacatcacggtgtcctcgcgttcgccggaggccctcgcccgcgacaagcggacgatccgcgcctccgccggcaagtcctacctgaagctggaatggtgcgaccgcgagcaccaccgcgccttcgtcaacaccttgccgttcgccaccggcatccgacgctagctggagggaagtgccgcccatgcgagatcccatgtccgccctgacggacgccttcaccagcttcctcttcggcaaagtcgaaaccacgcgcctgcccgtccgcacctccaccgggcaggcgcaagccgtctacctgcccaccgccgcccccggactcggcgactccggcgtcatcatcggccgcgaggtctacagcggcaagggctacatctacgaccccttccagctgtacggccaacagctcccggccccccactggctggtcctcggcgaatccggaaacggaaaatcagccctggagaagacctacgtcctgcgccagctccgcttcaaggaccgccaggtcgtcgtcctcgacgcccagggcgaggacggcgtcggcgagtggaacctgatcgcccagcagctggggataacccccatccgcctggaccccatcgccgccaacgacgacgggatccgcctcaaccccctcgacccggccatcaccgcgaccggacagctcgcgctgctccggaccatcatcgaagtcgccatgggccacggcctcgacgaacgcgccggcttcgccctcaaggtcgcccacgcctacgtcgtcgacaccatccgcgaccgccagcccgtcctcaccgacatcgtcgagcaactgcgccaccccgaggctgaatccgcgcacgcgatgaacgtcgacatagacgatgtccgggcctggggcctcgacgtcgcgctcgtcatcgaccgcctcgtcgacggcgacctgcgcggcatgttcgacggccccaccaccgtcggcatcgacctcgacgcccccctgatcgtcttcgacctctcccacatcgaccgcaactccatcgcgatgccgatcctcatggcgatcgtcggcgtctggctggagcacacctggatccgccccgaccggaagaagcgcatcttcctggtcgaggaggcctggcacatcatcaacagcccgttcgtggcgcagctgttccagcgcctgctgaagttcggccgccgcctcggcctgtccttcgtcgccgtcgtccaccacctctccgacgtcgtcgacggagcggcggcccgcgaggccgcggccatcctcaagatggcctcgaccagaacgatctacgcccagaaggcggacgaggcccgagccacgggccgggtcctgggcctgccccgctgggcggtggaaatcatccccaccctcacgcccggcatcgccgtctgggacgtcaacggcaacgtccaggtggtcaaacacctgatcaccgaagccgaacgccccctcgtcttcacggaccgcgccatgaccgagtcgtccgcccccgcccgcctccccgccgacatgctcgccgccgaactggaggcggaggaacgggccctgtccatcgaacgccgccgtggcggccccggttccgcgaccacggtggcctgaccatgcacgacgcaagacgtacggagcccgccgcgcgcggcggcggcatcccggacggcctgctggtcggcctcctggccttcctcctcggcctcgccgtcctcgtctggtcggccaccggcctcgccgccgtcttcgcgaacggcacctggcccgacacggtcaccttcacccggaccccgggggccgtccgcgccctgatagcgcagccgcacgacatccccgccgcctggccggacaccgacccggcggccctgtcgggctggggcctgttctggggcctgttcgtcagccagctcctggtgatgttcgtactcaccgtcttcgccatcggcgtcatcgcccgcaccaagtcccgccgcgccctggccaaacaccacaccgaacccgaaccggccaccccacccgcgcaacccaccccagccccggcgtcacagccagcccagccggcacagccagcctcgccggcgtttgaggcgcgggggtccgggggcagcgcccccggccacggcgccgcaccctccgacgaggcctaccgctacggcttcggctacgcgccccagccaacggcggcggcggcgaccacggcaacggcaacggcagcccccgtcccgcaggcgccggccgacggcctcgcctacgccggccccaacgaccgcctccacgccgccacccaccgcatccgggagaccgagggctcagccctcatcgtgacctcctcgcccaccctctgggccgagaccaaggacgcccgcgccaagctcggcccggtcctcctctacgacccttcccacctgtgcgacaccccggcccgcatgcactggaacccggccgagggctgcgccgaccgcgacaccgccgccgcacgcgcgatcgccctgctggcccccgtacgcccccaggcccgcatggacgccgcggtggccgacaccgcggaaaccctcctgcgcagctggctccaggcggccgccctggacgaccgcccgttcaagctgctccaccgctgggcccagggcaacagcgcccaggacccggtccgcgtcctgcgcacccacccgcaggccgcccccggtgcggccggcgagctggagagcgccctcaccgcccaccccgaacgccgtgagctcgcccagaacctgacggcccgtgccctctcctgcctgacctcgatccacatccgcgaggcctgcaatcccaaccgggccgatgccctcgccttggcatcattcgtcgccgaagggggaaccctttacttggtgggtgaagctctggaggatccccgcacccacccgggtgcgatgcccctgctcaccgcactcgcctctcacgtggtcgagcacggccgccgcatggccgcacggtcatcccacggtcggctcgacccaccactgtccctggtgctggacgacgtcgccgccgtggccccgatcccccagctcccagaactcctggccgagggaacgctccccctgctcgcccagtgccgcagccgcgaccaggcccgctcccgctggccggacgccgccctcccctagagggacaccggctggccgaaagccgtcagagcggtctcatcggcaacggcactcgaccgacaggaaccgctcctcgaccggagtgtcctcctccgtcctcagacggacgcagcgggctcagccggccgcgagtagacgtactcccgctccttggcacccgtctccagcggtatcagcagtccgctggcctcgaacccgtagcgccggtagaagctctccgcccgctggttgtcctcgtgcacgaacagccgcacccgctcagtcgccggctcctccagcgaccaggcccagtccagcgcggcgtcgaacagcctctccacgagcccgcttccccgctgctcgggccgtacgaacaccccgaccatgtggccttgctgctgctcgatggcctcaccgaagtagtcggtgccgccctgcgcctcgatgagcagggtcacggacccgacccaccgcccgtcaccggcctcggcgacgaactgccgggcaccccgcccttcggcggcacccgcggcacgctgctgccagaactcatcggcctgcgccagggcaccttcctcggtctccagaaaggccacggccgcagccggatcgcggagcgccaccaatcgcagctccttgaccttctcccactcgtcgccccgtacagccctgatcacgtagtcatcgctcatgctcgggatcttaatcacggggccgcagccggctcatccggtttccggctccgcattccgaccgtgaacgcagaaaagccccgcaccataaggtgcggggctttcccacaatgattgttcggcggcgtcctactctcccacagggtcccccctgcagtaccatcggcgctgaaaggcttagcttccgggttcggaatgtaaccgggcgtttccctaacgctatgaccaccgaaacactatgaaatttgaacacgctggcatggacacagctgttcgttatttcagaactaacacagtggacgcgagcaactgaggacaagccctcggcctattagtaccagtcagcttcacccgttaccgggcttccacatctggcctatcaacccagtcgtctactgggagccttaccctctcaaggaggtgggaatactcatcttgaagcaggcttcccgcttagatgctttcagcggttatccctcccgaacgtagccaaccagccatgcccttggcaggacaactggcacaccagaggttcgtccgtcccggtcctctcgtactagggacagcccttctcaatattcctacgcgcacagcggatagggaccgaactgtctcacgacgttctaaacccagctcgcgtaccgctttaatgggcgaacagcccaacccttgggaccgactccagccccaggatgcgacgagccgacatcgaggtgccaaaccatcccgtcgatatggactcttggggaagatcagcctgttatccccggggtaccttttatccgttgagcgacggcgcttccacaagccaccgccggatcactagtcccgactttcgtccctgctcgacccgtcggtctcacagtcaagctcccttgtgcacttacactcaacacctgattgccaaccaggctgagggaacctttgggcgcctccgttaccctttgggaggcaaccgccccagttaaactacccatcagacactgtccctgatccggatcacggaccgaggttagacatccagcacgaccagagtggtatttcaacggcgactccacaaccactggcgtggctgcttcaaagtctcccacctatcctacacaagccgaaccgaacaccaatatcaaactgtagtaaaggtcccggggtctttccgtcctgctgcgcgaaacgagcatctttactcgtagtgcaatttcaccgggcctatggttgagacagtcgagaagtcgttacgccattcgtgcaggtcggaacttacccgacaaggaatttcgctaccttaggatggttatagttaccaccgccgtttactggcgcttaagttctcagcttcgcaaccccgaaaggtcactaaccggtccccttaacgttccagcaccgggcaggcgtcagtccgtatacatcgccttacggcttcgcacggacctgtgtttttagtaaacagtcgcttctcgctggtctctgcggccacccccagctcacggagcaagtccgatcaccagtgatggccccccttctcccgaagttacgggggcattttgccgagttccttaaccatagttcacccgaacgcctcggtattctctacctgaccacctgagtcggtttagggtacgggccgccatgaaactcgctagaggcttttctcgacagcataggatcatccacttcaccacaatcggctcggcatcaggtctcagccttaatgagggacggatttgcctacccctcggcctacacccttaccccgggactaccaccgcccgggctggactaccttcctgcgtcaccccatcgcttacctactacaagtctggttcgtcggctccaccactttcctttccccgaagggtccggaacggcttcacggacttagcatcgcctgattcgatattgggcgtttcaaagcgggtaccggaatatcaaccggttgtccatcgactacgcctgtcggcctcgccttaggtcccgacttaccctgggcagatcagcttgacccaggaacccttagtcaatcggcgcacacgtttctcacgtgtgtatcgctactcatgcctgcattctcactcgtgaaccgtccacaactagcttccgctgctgcttcacccggcacacgacgctcccctacccatcacagcgggcgttggccctattgctgcaatgacacgacttcggcggtacgcttgagccccgctacattgtcggcgcggaatcacttgaccagtgagctattacgcactctttcaagggtggctgcttctaagccaacctcctggttgtctctgcgactccacatcctttcccacttagcgtacgcttaggggccttagtcgatgctctgggctgtttccctctcgaccatggagcttatccccgacagtctcactgccgtgctctcacttaccggcattcggagtttggctaaggtcagtaacccggtagggcccatcgcctatccagtgctctacctccggcaagaaacacacgacgctgcacctaaatgcatttcggggagaaccagctatcacggagtttgattggcctttcacccctaaccacaggtcatcccccaggttttcaaccctggtgggttcggtcctccacgaagtcttacctccgcttcaacctgcccatggctagatcactccgcttcgggtctagagcgtgcaactcaatcgccctattcggactcgctttcgctacggcttccccacacgggttaacctcgctacacaccgctaactcgcaggctcattcttcaaaaggcacgcagtcacgactgtatgtgcaagcacatacagcgacgctcccacggcttgtaggcacacggtttcaggtactatttcactccgctcccgcggtacttttcaccattccctcacggtactatccgctatcggtcaccagggaatatttaggcttagcgggtggtcccgccagattcacacgggatttctcgggccccgtgctacttgggagattcttaagcaagccgctgatgtttcgtctacgggggtcttaccctctacgccggacctttcgcatgtccttcgactacatcaacggtttctgactcgccgaccggccggcagaccgatcaaaagaattcccacaaccccgcatgcgcaacccctgccgggtatcacacgcatacggtttggcctcatccggtttcgctcgccactactcccggaatcacggttgttttctcttcctgagggtactgagatgtttcacttcccctcgttccctccacactgcctatgtgttcagcagtgggtgacagcccatgacgactgccgggtttccccattcggacacccccggatcaaagctcagttggcagctccccggggcctatcgcggcctctcacgtccttcatcggttcctggtgccaaggcatccaccgtgcgcccttaaaaacttggccacagatgctcgcgtccactgtgtagttctcaaacaacgaccagccacccgtcacacactccctgaggaatgctttaccggggccggcactgaagacatgaccttacggccgtaccttcaggacccaacaacgtgccaggcacgatcccgtccacttcactgtgttccacgccgaagcagtacttacagagagtttcagaaaccgtgccaactaatcaacgttccacccatgagctgaccgtgcagaacgtttgtctgcaatcggtactgtgctccttagaaaggaggtgatccagccgcaccttccggtacggctaccttgttacgacttcgtcccaatcgccagtcccaccttcgacagctccctcccttacgggttgggccaccggcttcgggtgttaccgactttcgtgacgtgacgggcggtgtgtacaaggcccgggaacgtattcaccgcagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccgagttgaccccggcggtctcctgtgagtccccatcaccccgaagggcatgctggcaacacaggacaagggttgcgctcgttgcgggacttaacccaacatctcacgacacgagctgacgacagccatgcaccacctgtataccgaccacaaggggggcactatctctaatgctttccggtatatgtcaagccttggtaaggttcttcgcgttgcgtcgaattaagccacatgctccgccgcttgtgcgggcccccgtcaattcctttgagttttagccttgcggccgtactccccaggcggggaacttaatgcgttagctgcggcaccgacgacgtggaatgtcgccaacacctagttcccaacgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagctagcccgtatcgaatgcagacccgaggttaagcctcgggctttcacatccgacgtgacaagccgcctacgagctctttacgcccaataattccggacaacgcttgcgccctacgtattaccgcggctgctggcacgtagttagccggcgcttcttctgcaggtaccgtcactttcgcttcttccctgctgaaagaggtttacaacccgaaggccgtcatccctcacgcggcgtcgctgcatcaggctttcgcccattgtgcaatattccccactgctgcctcccgtaggagtctgggccgtgtctcagtcccagtgtggccggtcgccctctcaggccggctacccgtcgtcgccttggtgggccattaccccaccaacaagctgataggccgcgggctcatccttcaccgccggagctttcaacccccgcccatgcaggcaggagtggtatccggtattagaccccgtttccagggcttgtcccagagtgaagggcagattgcccacgtgttactcacccgttcgccactaatccaccccgaagggcttcatcgttcgacttgcatgtgttaagcacgccgccagcgttcgtcctgagccaggatcaaactctccatgaatgtttacccgtaatcgggtgcacacatcacttagagcgggcgcatcatgtcggaataagaccgacgcgccacaacgtcctcgctgtgttgttgcctgcaagtgctccacaaggaagccttacaggtctttttcaaaggaacctcatccaccgaagtggacggggtatcaacttctggcgttgatttttggcacgctgttgagttctcaaggaacggacgcttcctttgtactcaccctctcgggctttcctccgggctttcgttctgttcttgcgtttccgactctatcagactctttcgtgtccgacttcctcggcgctttccaggtttttcgctttcgcgctttccctttccggcggttccgactctatcagaagttctccaccggatttccccggcttccgattcctgaaggcgtcgagtgcaccccacacgaaattacattccttgggggtgggctgccgaacttgtccagttcgaggcaaccgtttgactctacaactcggcctgtggggtgtcaaaacggcctcggggcctcggcctgtgccctggtcaggggcggtgagacgggtgccgccggagtgtcctcccgggccgctatcgcgttgcggacggaccggttcgggtcttcggccagccgatcacgaccagggcgatgtctcctcctcgccctcggtgatgtcggaccaccgctcgggcagcgcgtcgacataggcggtggtgcgttccgacggagctacctcgatctcaccgtcggggtagcgctcgtacagatcccggaacgttcggcgagcgcgcctgccgtccggtggccggtcgccttcccggaccgccaggtcgtaggtcattccgggaggccctcacaccgcactgaggcaggagctccatcggcagacggtcgttcgtcgggatgaatgaccgcacggagggatccgggtcctccgccaggcgggccagcaccccgggcggttcgtccccgacgctcgcggcgaccgcacaccggaccgccggctccgggtggccggacgatcgcgcgggtcgccgcgccgtgaggtgggatgcggctccccgctcaggggaccaggacgaccttgccgaggttccggcgctgctcgatgaccgcgtgagcgcgggcggcctccgcgagggggatctcctcgtgcacagccgtacgcagggtgcccgcggcgcgcagctgccacagctcgcgcagccagcgctcgtacagttcgggcttgccggtggcgatggcccgcatctggtagccgatcaacgaggctccgcggacgaggagttcgtacgcctccaccgtgccaccgcccgagccgaaagccaccaggcggccgcccgtcgccagggctcgtacggcggggccgagcaggtcgccgccgacaccgtcgaggatcacgtcgtacgggccgccccagtcggcgtccccgtacaggacgacctcgtcggcgccgaggccgcggacgaagtcggccttgtcggcactgctgacggccgccacgacgcgccccgcccggccggccttcgcgtattggagggcgagcgtgcccacggcgctcgccgccgccgtcaccaggaccgactcgccgggctccacgcgcgcggcctcgtacgcgccgcgggcgaccagcccgctgcggaccagcgcgaccgcctccacggcgctcgcgccggccgggatccgggaggtcatcgcggtgccgagcaccgcgtactcggcgtaggcgtcggcgaagcacaggccggtgacgcgttcaccggtggtgaatccggtgacgtccgggccggcggcgactacggtccccgccacctcgccgccgagcgacacgggccggccgccctctcgcacatccctcacctcccgcaccttgcgcacggtcgggagggtcacgccgaccgcctcgaccttgatcagcagctcgccggcaccggccacgggtacgtcgccctcctcggcgaacagcacttccggcccaccgttgacctcatggcgcatgcgcagcacaggacacccccgaactcgacagattcattggatgtcccaacgataagtctaaagtcgtgggtatgtccaacgactttcggtagggtgagcccatgacctcggcactccagcacatccagtcactgccctcctggctcgtcggccgcgtcgcggcccgcggccgcgggctggtcgcggcggcgatcgccgcggaggggctgaagctcatgcaccacgcggtactggccgccaccgccgagtacgggcccgtggcccaggccgacttgggccgcctgctcgccgtcgaccccaaggacatggtcggcatgctcaaccacctccaggaggcgggcctcgtcctgcgcgccccggatcccggcgaccgccgtaagaacgccgtcaccgtcaccccggaggggacagccgtgctcgcccgctgcgcggccctggccgaagccgccaacgccgagttcctcgccccgctcgacccggccgagcaggaccagctggtggccctgctgacccggctccacgaagccccgtaggccggccgaacgaccgaagcgcgcacgacgagcgcgccctcgcccggtgcggggcgaaggctccccacgcctccctcccgcgcaagccgatcgaggcacccgggacttcgtaggccggccatcccgcaccagtcggagcctgtcttggggccgccgtgtagaggccttcgctcgggagctcgccgcgacacgctctcccacgacctcgacaccactctgcgccgccgaatgccggccgggctcatcgtgcagaggcccgctcctggtggaaatcgggtactcgccgcggatacggcctgcgaggctgtgagggtgactgagacgaccccttacgacgccgaccgtgcccggttcacccgccaggctctggcacgcctcgtcctgtccgatcacgccgtggacgttgcggatggcgccgccggcctggttgccaccgagaacgaccccgacaccggtcccgggggccgggcgagccaggcattccagctcatcgagctcgcggagcgcgcgctggtctcggccgtcgtctacgaacgggagcgaggcagctcttggacggagatcgcccagtacctgggcatcggtccggcagaagcggaagagcggttcggtgcgagccttgacaactggaacacggccttcgaggttccctaccggctcgacgacaccggtcgaaagcgcatacctcagctgcccacggcagcgtatgaccccgcttgggcctgcaaccagctcgacacctgggccaggaaccggctcgttcttgtcaacgaaaagcgtcccgtcagcgcgggtctcgtcaaggctgtaccggaggaagagctcccgccagtgactccgtagcgggtttgctggaaaggcgatcgcttcgtcgaacggaccgcgcgcctggagacagtgacggagccggccgagcatccggttgaagaggcgccgcagagtctgcgtgtgccagccccttcctgcccggcggcgccggtagtgggactccgcgccagatgaaccgctgggggaggcgaaagcccacaggtggccgacgtggttgaggcggtgcctgcctgcccgtggcgtctacctgtgcgcgggccgtacggcgaccgcttgggccgggtcggtgtcggcgggcagcggccgctgcacgggcgcgtcggtgcggatgatgtccgcgagcaccagggcgtcacccgggtccgacctcttgcggctgactccgtgccggtcgcggtagcgggagacagccatcgggttgcaccacgtagatctgccgggggctctgccgcagcgtggcgaccaataagccgcggctggtctcgatggccgccgcacggcgctgttcgaccagtaccggcagcctgtcggtccactagaggaagccggtccgcctgtgctgcgtgaggttctcggtgatctcgtgtagccacggggtgcggacggcgggcagccgggccagggttcggtggaagacttcccagtcgatccggaacacgtcatggacattcggcgtgggcgggtcgtcgcgaaggacgccgtcgggcattggacccgatgcggggacgggcagctgcggctcggggaaggccagccggagccacaccccgaacggcaagggaaccaagtacgccggagcggccggggtccatgccttcccggtctgtgggtgggaaggcacgagcaggatgtccgcgtcagcgtcgaggggcggccgtcccggtccggccaggaccgcgcgccgcgtcggcctgccggccggcagcagggcgtcgagcgcgcgttggaacatcctcgaggccaagccgtcctgaacggctaccggctggccttccgaggccaccaggaggtgggcgaacgcctgcccggctgccgccacccactggggactccagtgccaccggtcgcccgcccgaaacggctctccccacgaggcgatcggctcggacggcggcacgccggccccctccgcgagcagctctgtccaggacgacggcccggcgtcggctccttcgacgggaaagcggcatacggcgttcggggcgagccacacggcctgccagagcgagcagtcgtcgatcctgctcgccacgagaagaccgcatgcggcgcaggccatgttggggccgtcacccccgtcgaagccgcagcaggcgccgccgcgcttctccgggatcagcacagtgccgcgggtgtctcccggtgcgacaacgaccgcgccggccgcgccttcggacagggcctgagccggcgcgtagatgccgcgggcagccgcctcgtccggatcgatcacctgccgccttcgccaaggcgcccagggctcccgttccacggcgaacgtccctgattccatgagcaccgggagctgaagcccgttcccgtacttctgacgggcgtgtgccggcatggcgacctcggacaaaggggcggtcagctcggcgccacaccgcacacagacgaaaacgaacaaacgtcctccgctcaggaaacacgggcatcgtcgcagctccgtggcagaccggccaacgtgcttttcactccgttgtggggccgaagcacagacacgacgcccacgacgccgagcgtcaccgttcgaatcctcagtagcctctgccgccacccgaagtggcgaacatctgcggcccggtctcgggctctggcacaacttctgtggacccatggcagtggtctccggcttcccggataaggattcgtccgcagcgatcggtgtgtctaccctgagtcgcagcgggagtgcgcgcattcccgcaggttgcagtgccgtggcagagcggcccaatgcgatcgacgtgggcgaggtccctcccacggcgactgacggagacggagcggacctgctcccatctgtccgcgggttcaaatcccgtcggcactgcagccgacctcgacttggtccagcgcacggacctgccgcatcgcaccaggtccacagaagttgtgccagagcccggtctcgtggacaaagccagccgctgccgcaaaagaggtgccactcacctgcgtccaggcctggcgtgacggcgtcgagctccgcctccgcccgtcggttgccgggcaaggcgcaagcacccagaccctgttgccgcctcggcggcctctgcgcgctggtggctgggacttctccggccgatcgtggtggtggggccgtcggggatgatgcgcgggtgagcatcatcgtgaagttcttcgtggcgccggacgacacgtcagcgagcctgaccctgcggaccgggccgggacgggcattcgagtcgctctccttcggcaacttcgatcccgaagaggcggtgatcgagtgggaatgcctcctcgtcggcagcagcttcgaggaactggccgaagccggtgagcctcgcatcgtcgccggccaggacaatgacgggtgcgtcgtcttcgcgatatcggctcgtctgtccgctgcactcgcggaggccggacacgccaggttgcgtggcgtcgctgcctcgtgggctcagctgcgtgcggaggacggagaggtcatcgacacggaagtcgcggacgcgatcgtgggtgacctggctgccctcgtcagcagcgcccggcgccagaaccagggcgtctactgctgggtcgcgtaggagttcgtgttcggagccggacggcggcggacgtctcggtggcggcggcggtgccaaggcagacgtagccgcgcctgtcgtagcgagtcgcggccgcccgggactgcttgaggcggcggatctgccgaacgcagccggatcgccgtccaccgcgtgcgcccttgcgcatccgggcaaacgaggccgctggtgcgtgcccgtcctgtcgtcctcaaacgggccgtgaacgcagaaaagccccgcaccataaggtgcggggctttcccacaatgattgttcggcggcgtcctactctcccacagggtcccccctgcagtaccatcggcgctgaaaggcttagcttccgggttcggaatgtaaccgggcgtttccctaacgctatgaccaccgaaacactatgaaatttgaacacgctggcatggacacagctgttcgttatttcagaactaacacagtggacgcgagcaactgaggacaagccctcggcctattagtaccagtcagcttcacccgttaccgggcttccacatctggcctatcaacccagtcgtctactgggagccttaccctctcaaggaggtgggaatactcatcttgaagcaggcttcccgcttagatgctttcagcggttatccctcccgaacgtagccaaccagccatgcccttggcaggacaactggcacaccagaggttcgtccgtcccggtcctctcgtactagggacagcccttctcaatattcctacgcgcacagcggatagggaccgaactgtctcacgacgttctaaacccagctcgcgtaccgctttaatgggcgaacagcccaacccttgggaccgactccagccccaggatgcgacgagccgacatcgaggtgccaaaccatcccgtcgatatggactcttggggaagatcagcctgttatccccggggtaccttttatccgttgagcgacggcgcttccacaagccaccgccggatcactagtcccgactttcgtccctgctcgacccgtcggtctcacagtcaagctcccttgtgcacttacactcaacacctgattgccaaccaggctgagggaacctttgggcgcctccgttaccctttgggaggcaaccgccccagttaaactacccatcagacactgtccctgatccggatcacggaccgaggttagacatccagcacgaccagagtggtatttcaacggcgactccacaaccactggcgtggctgcttcaaagtctcccacctatcctacacaagccgaaccgaacaccaatatcaaactgtagtaaaggtcccggggtctttccgtcctgctgcgcgaaacgagcatctttactcgtagtgcaatttcaccgggcctatggttgagacagtcgagaagtcgttacgccattcgtgcaggtcggaacttacccgacaaggaatttcgctaccttaggatggttatagttaccaccgccgtttactggcgcttaagttctcagcttcgcaaccccgaaaggtcactaaccggtccccttaacgttccagcaccgggcaggcgtcagtccgtatacatcgccttacggcttcgcacggacctgtgtttttagtaaacagtcgcttctcgctggtctctgcggccacccccagctcacggagcaagtccgatcaccagtgatggccccccttctcccgaagttacgggggcattttgccgagttccttaaccatagttcacccgaacgcctcggtattctctacctgaccacctgagtcggtttagggtacgggccgccatgaaactcgctagaggcttttctcgacagcataggatcatccacttcaccacaatcggctcggcatcaggtctcagccttaatgagggacggatttgcctacccctcggcctacacccttaccccgggactaccaccgcccgggctggactaccttcctgcgtcaccccatcgcttacctactacaagtctggttcgtcggctccaccactttcctttccccgaagggtccggaacggcttcacggacttagcatcgcctgattcgatattgggcgtttcaaagcgggtaccggaatatcaaccggttgtccatcgactacgcctgtcggcctcgccttaggtcccgacttaccctgggcagatcagcttgacccaggaacccttagtcaatcggcgcacacgtttctcacgtgtgtatcgctactcatgcctgcattctcactcgtgaaccgtccacaactagcttccgctgctgcttcacccggcacacgacgctcccctacccatcacagcgggcgttggccctattgctgcaatgacacgacttcggcggtacgcttgagccccgctacattgtcggcgcggaatcacttgaccagtgagctattacgcactctttcaagggtggctgcttctaagccaacctcctggttgtctctgcgactccacatcctttcccacttagcgtacgcttaggggccttagtcgatgctctgggctgtttccctctcgaccatggagcttatcccccacagtctcactgccgtgctctcacttaccggcattcggagtttggctaaggtcagtaacccggtagggcccatcgcctatccagtgctctacctccggcaagaaacacacgacgctgcacctaaatgcatttcggggagaaccagctatcacggagtttgattggcctttcacccctaaccacaggtcatcccccaggttttcaaccctggtgggttcggtcctccacgaagtcttacctccgcttcaacctgcccatggctagatcactccgcttcgggtctagagcgtgcaactcaatcgccctattcggactcgctttcgctacggcttccccacacgggttaacctcgctacacaccgctaactcgcaggctcattcttcaaaaggcacgcagtcacgactgtatgtgcaagcacatacagcgacgctcccacggcttgtaggcacacggtttcaggtactatttcactccgctcccgcggtacttttcaccattccctcacggtactatccgctatcggtcaccagggaatatttaggcttagcgggtggtcccgccagattcacacgggatttctcgggccccgtgctacttgggagattcttaagcaagccgctgatgtttcgtctacgggggtcttaccctctacgccggacctttcgcatgtccttcgactacatcaacggtttctgactcgccgaccggccggcagaccgatcaaaagaattcccacaaccccgcatgcgcaacccctgccgggtatcacacgcatacggtttggcctcatccggtttcgctcgccactactcccggaatcacggttgttttctcttcctgagggtactgagatgtttcacttcccctcgttccctccacactgcctatgtgttcagcagtgggtgacagcccatgacgactgccgggtttccccattcggacacccccggatcaaagctcagttggcagctccccggggcctatcgcggcctctcacgtccttcatcggttcctggtgccaaggcatccaccgtgcgcccttaaaaacttggccacagatgctcgcgtccactgtgtagttctcaaacaacgaccagccacccatcaccctgctctcgaagagaacaagttcactggggccggcactgaagacatgaccttacggccgtaccttcaggacccaacaacgtgccaggcacgatcccgtccacttcactgtgttccacgccgaagcagtacttacagagagtttcagaaaccgtgccaactaatcaacgttccacccatgagctgaccgtgcagaacgtttgtctgcaatcggtactgtgctccttagaaaggaggtgatccagccgcaccttccggtacggctaccttgttacgacttcgtcccaatcgccagtcccaccttcgacagctccctcccttacgggttgggccaccggcttcgggtgttaccgactttcgtgacgtgacgggcggtgtgtacaaggcccgggaacgtattcaccgcagcaatgctgatctgcgattactagcgactccgacttcatggggtcgagttgcagaccccaatccgaactgagaccggctttttgagattcgctccacctcacggtatcgcagctcattgtaccggccattgtagcacgtgtgcagcccaagacataaggggcatgatgacttgacgtcgtccccaccttcctccgagttgaccccggcggtctcctgtgagtccccatcaccccgaagggcatgctggcaacacaggacaagggttgcgctcgttgcgggacttaacccaacatctcacgacacgagctgacgacagccatgcaccacctgtataccgaccacaaggggggcactatctctaatgctttccggtatatgtcaagccttggtaaggttcttcgcgttgcgtcgaattaagccacatgctccgccgcttgtgcgggcccccgtcaattcctttgagttttagccttgcggccgtactccccaggcggggaacttaatgcgttagctgcggcaccgacgacgtggaatgtcgccaacacctagttcccaacgtttacggcgtggactaccagggtatctaatcctgttcgctccccacgctttcgctcctcagcgtcagtaatggcccagagatccgccttcgccaccggtgttcctcctgatatctgcgcatttcaccgctacaccaggaattccgatctcccctaccacactctagctagcccgtatcgaatgcagacccgaggttaagcctcgggctttcacatccgacgtgacaagccgcctacgagctctttacgcccaataattccggacaacgcttgcgccctacgtattaccgcggctgctggcacgtagttagccggcgcttcttctgcaggtaccgtcactttcgcttcttccctgctgaaagaggtttacaacccgaaggccgtcatccctcacgcggcgtcgctgcatcaggctttcgcccattgtgcaatattccccactgctgcctcccgtaggagtctgggccgtgtctcagtcccagtgtggccggtcgccctctcaggccggctacccgtcgtcgccttggtgggccattaccccaccaacaagctgataggccgcgggctcatccttcaccgccggagctttcaacccccgcccatgcaggcaggagtggtatccggtattagaccccgtttccagggcttgtcccagagtgaagggcagattgcccacgtgttactcacccgttcgccactaatccaccccgaagggcttcatcgttcgacttgcatgtgttaagcacgccgccagcgttcgtcctgagccaggatcaaactctccatgaatgtttacccgtaatcgggtgcacacatcacttagagcgggcgcatcatgtcggaataagaccgacgcgccacaacgtcctcgctgtgttgttgcctgcaagtgctccacaaggaagccttacaggtctttttcaaaggaacctcatccaccgaagtggacggggtatcaacttctggcgttgatttttggcacgctgttgagttctcaaggaacggacgcttcctttgtactcaccctctcgggctttcctccgggctttcgttctgttcttgcgtttccgactctatcagatcctttcgggcctgacccccagtcagcggggcttgtcttccgggctgttgggcccttccgactcctgaactctagtggatttccccggcgattcataatcggccttcggaaatgaattcgggcacgccgaattcgttcccagtgggagatcgtgctgagttgagtgccgcaacgaggcggcgggattcgttgtcgccacaaccttccagctctgggacaactcgaagaaccttacggatccgtggggctcgtgtcaaccccggcggtcagctgggtgactggaggtcttccacgcgatccagcaggcgggtgagcatgtcgcccagcaccccgcgttccgcggtggagaggtcctggaggaggtcctcctcgaagaccgtggccgcccgcatcgcgtccagccacttgctgcggccctcgtccgtgagctccacgatcacgcggacccggttcgactcgtcccgctcgcgggtgaccaggccctccgccgtcatgcggtcgatccggtgggtcatcgccgccggcgtgaggcccagctgcttcgccagttcgctcgggcccatccggtagggcgcgccggagatgacgagtgccttgaggacctcccattccgcgttgctgatgcccagggccgccgtctggcggccgtacgcgacgttcatgcggcggttcaggcggctcagtgccgagacgaccttctcgacctgggggtccaggtcctggaactcgcgctgatagacggcgatctgttcgtcgaggctcggctcgtggacgggcgcagtgccgtcgggggtgtcacccatgggtcgaagtatcgcacgagctcgttggcgtctaactccttcgatgtgtactgttaaggcttgaagtttaggtatgaagtcttcaggcttcaggtctcaaaggcaggtgagaagtgaccaaggtgatgggcgctgcgatgcggcggatccaggccgggaacgcgctgaccgcgttcggcatcggtttcacggttccgttcctctacatctatgtggcgcaggtgcgagatctgggttccatggccgccacgagcgcgttcgtggccttcgccctgggcgctctcgtcgcgctgcccttcaccggccgggtcatcgaccgacgtggtccggtgcccgtggtcataggggcggccgtcaccgcctcggccggtgcgctctcgctcgggctctccaccggcatcgtgcccatcctgctgtcggcgctggcgctcggcgccggtcaggccgtgatgcagccggcgctggccacgatgatcgtgtggtgctccacgccgtccacccggacccgtgccttcgccctgcagttcttcatgcagaacctggggctgggcatcggcggtctcatcggcggccagatcgtcgacgagaaccggcccggcagtttcacgctgctgttcggcatcgaggccgtgatgttcctggtgctggccgccgtcatcctcagcgtgcggctgccgcacgtgccggccatcaaggacgccatgccgaaggacccgtcccaggcgggtggcagcggctggaagcggctgctccggcacaaggccatggtgcagctgtgcgtgctgggcttcgtggtgttcttcgcctgctacggacagttcgagtcggggctggccgccttcggtaccgaggccgccgggatctccccctccaccctcggcttcgcgctcgcggccaacaccggtgcgatcgtcgtcgcgcagttcgtcgtactcaagctggtcgagaagcgccgccggtcgcgggtcatcgcgctcgtcgggctgatctggaccgtggcctggctcatcgccgggttctcgggtctggggcacggcagcgccatgatggccgccgccgcgttcatcgccacgtacgcgctcttcggtatcggcgaggccatgctgtcgccgactctggcgccgctggtggccgatctggcgcccgagggttcggtgggccagtacaactcggcgttcgcgctggtcaagcagatggcgctggcgctggggccgctcggggtgccgctcggtgccggggttcccatgctctacatcggagtcttcgtgctcgtgtcgctcgggatcgccgctctcgcgctgcggctcggcaggcggctgagcccggtgcaggacaacccgtgggtggcgagcagggtcgtggcgcagggcggtccggccgtcgtggccaaggagaccgtcgtggagcccgtccacgcgtgagcgtcgtgtgagcggatgtggcgtgcgtatatacgtacggacgtacggatgtgcggaaggccccggtccgggtgggtcggggccttccgcgtgttcggctacttgtccggcagggcgaactcgcaccagacggccttcccgccgcccggggtgcggcgggaaccccaggaggaggcgatggtcgcgatgatcgagatgccgcggccggtctcgtcggccggttcggcgcggcgtcggcgcgggaggtggtcgtccccgtcggtgacctcgatgatcagccggcggtcggtacggcgcagccgcaggctcatgggcggggtgccgtgctggagggagttcgcgacgagctcgctggcggccagcactccgaggtcgcagagctcgacggggaaccgccaggaggcgaggacgccctgggcgaaggcgcgggcgcgcggagcggcctcgatgccgccgaggagttccagggcggcgttgtggaagagctcggcgtccgatccggtgcgggccggctgctggaggaccatcacggcgacgtcgtcgtcgtggtcggcgtccacgccgagggcgcgcatcagccggtcgcagatgacggccggggtgccctgtgcgccggagagggcgcgttcgagggcggcgacgccctcgtcgatgtcctcgccgcggcgttcgaccaggccgtcggtgtagaggacggcggtggagccggggcccagggcgatggtgcccgaggtgtggagccaaccgccggtgccgagcggtgggccggtggggtcggcggctctgcgtacggtgccgtcctcgtcgcggaccaggatcgggaggtggccggcggaagcgtacgcgagcaggccctcgttggggtcgtggaccgcgtacacacaggtggcgatctggctggcgtcgatctcggcggcgaggccgtcgaggagctggagcacctcgtgcgggggcaggtcgaggcgggcgtaggcgcggacggcggtgcgcagctggcccatgacggcggcggcgcgcacgccgcggcccatgacgtctccgatgacgagggcggtgcggccggcgccgagggtgatgacgtcgtaccagtcgccgccgacggcggcctcggtgccgccgggctggtaggtggcggcgacgcgcaggtcgtcgggctgttccagctcctgggggaggagggagcgctggagggtgacggcggcctcgcgctggcggcgttcgctggcgcggagccgctcgacggcctcggcgtggtcggtgacgtcggcgaggtggatcaggacgccggtgcggtgggcctccgcctcgtgcccgctgccggatccggatccggcttcggcagtggtgccggtctcggttccgggggcggcctcggggaactcgacgggggtgcaggtgaccgtgtacgagctgccgccgcccggtgcggtgcggttcttggcggtacgggacttgccgctgcgctggacctggtcgaggagcgggaggaggccgagctcgccgagttcggggagggcctcgtgggcgggggcgccgggggtgcgggcgccgaagccggcggtgtaggcgtcgttgacgtaggcgaggcggtgctcggggccgtggacgagggccaccagggccgggagccggcccaggacctcgcgtgcggagagctcgtcgagggagggagcggcggtgaggacgcccgtccgccgggacgtcggcgtggacggtgacgggggcgtgccggtgccaccgcctccggcgccactcccggtaccggtaccggagaccgtggggtcggcgggccggccgtcggcgggcgtggaccgctcggctccggggtcggcgcggccgccgcgggctgccgggaccgcgccttcacctcgcttggcctgggcggcggcgtgttcggaccgggcggcggcgcggcgctgcgttccggggaaccgggcgctccagcgcgtgaagttcactgcgttcaagcctcgtggtgtcgcgagtggtcgctgtgtcgctcatgggcggtcgctgactggacgatgtcactctgtgcaggggtgagcgcacctatggtcacacgtccagtgtggccgaccgcactgacaacgtcagccctggccgttctgcggggggttgggggcggggggcgggggagggggcttggggccgccgcctgcggccagttcgaattctgccctggggtgttcgagggaacccagggagacgatctcacgcttgaagaggccggcgagggtccattcggcgaggacgcgcattttgcggttgaagctggggacgcggctgaggtggtaggcgcggtgcatgaaccaggccgggtaggccttgagcttgcggccgtagatgtgggcgacgccccggtgcaggccgagcgaggcgacggagcccgcgtacttgtgggcgtactcggtcaggacctcgtcgcggagggcggcgaggaggttgtcggcgaggactttggcctggcggacggcgtgctgggcgttgggggcgcattcgcggcccttctcggccgcggtgatgtcggggacggcggcggcgtcgcccgcggcccaggcgtgttcgactccttcgacggtgaggaaggaggtgcaggccaggcggccgcgttcgttcttggggaggtcggaggcggccaggatcgggtgcggtttgacgcctgcggtccacacgatggtgcgggtggggaagcgggcgccgtcgctgaggacggcgacgcggttctcgcaggattcgagccgcgtctccaggcgtacgtcgatgttgcgccggcgcagttcccggaccgtgtagacgcccatctgggggccgacctcggggaggatccggtcgctggcctcgacgaggacccacttcatgtcctcgggcttgatgttgtggtagtaccgcgaggcgtagcgagccatgtcctccagctcgccgagggcttcgacgcccgcgaagccgccgccgacgaagacgaaggtgagggcggcgtcgcggagggcgggatcccgggtggaggaggcgatgtccatctgttcgatgacgtggttgcgcagcccgatggcctcttcgaccgtcttgaatccgatgccgtagtcggcgagtccggggacggggagggtgcgggagatcgagcccggggcgaggacgagttcgtcgtactccatctcgacggggccggatccctcgtcggcggtggcgagggtgctgacggtcacggtccgtctggcgtggtcgatgcgctgggcctcgccgatgacgatgcggcacttgccgaggacgcggcgcagcgggacgacgacgtggcggggcgagatcgcgcccgcggccgcttcggggaggaagggctggtacgtcatgtagggctcggcgctgaccaccgtgacctcggcttcgccggctctcagctttcgctggaggcggagcgccgtatacatgccgacgtagccgccgccgacgatcaggatgcgcgtacggggcggggtaccgggggccgtgccccgggagttagcagccttcaccatcccatgacgcaacgtggccgggagtttgtccacaggcccggcaaattgtgtgaccggagtgagtgttggggcggggtggaaggggagctccgcttgtggcgaaaatctgcaggtcagagcatgcggaatgcgggattccggaggcacggaacggaaaagtgggggtgaatgctccgatcgggcggtgctccgtccggggctgcctcttctgaattgactctggctcaactatgttcgtatctcgtcgaggagtaggaccgggcctgagaccgtggccccctcgacgtgaaggcggggagtgtctccggggggagacaaatgattaccgggggatacatatgaacatttccgatttccatggttctgcgaccgcgctctcggtcgagagcaacgggcgcgccatcgcgggcggcaccacgcacgcggtaggccggtccacgccgctgcgcgtcgacgcccagcgcaacctggagcacgttctgcgggcggcccgtgaggtcttcggcgaactgggctacggggctccgatggaggacgtggcgcgccgcgcccgggtcggtgtcggcaccgtgtaccggcgtttcccgagcaaggacgtcctcgtgcggcgcatagccgaggaggagaccgcgcggctgaccgagcaggccaaggccgcgctgggccaggaggaggagccgtggcaggcgctgtcgcgcttcctgcgcacctccgtggcctcgggcgcgggacggctgctgccgccgcaggtcctccgggtcggcgggaccgtcgaggacgaggccgaggaggcggaggccgctcgggttccgcagcagcggcaggccgttccggccgccggggctccggacctgcgggtcgtgggccatcgcggctccgccgacaacgagccctcggacgacgcgggtgcgggtgcgctgctggaggtcgtcggccggctggtgcaccgggcgcgggaggccggtgagctgcgtgccgatgtcaccgtggccgatgtactgctggtgatagcgacggcggcgcccgcgctgcccgacccggcgcagcaggcggcggcctcgacgcggctgctcgacatcctgctcgaagggctgcggtcccggacggtgtgatcccggcgggccggtgagcgtccggtggggcgattcgccggaatgtgcccggacgggtggatggtgcgcagaggggtccggtgcccgtcccccgtgtgacacgcttggccggtgtaccggttgagtgtgtcgtgcgggagcctccgcgatgagcgttgacggtcgggaagagccacgcggtggcggcggcagcgaggtggaggcgggcagtctgcccgcacgacaggtgccggcgcagcgcgacccgggcgggcggcacgcacgcccctcgggctcttccgggcccggagtcttcggaggctccggtggtgagcagccgccgtccgacggggacttgatcgcccggatgcggggcggtgacgacggtgcgtacgaggctctgttccgtcggcacgccgatgccgtgcgccgctacgcgcgatcctgctgccgggacggacacaccgccgacgacctgaccgccgaggtgttcgcgcggaccctgcaggcggtacgcggcggggccggaccggaccagtcggtgcgggcctacctgctgaccaccgtgcgcagggtcgccgcggcctgggcgaagaccgccaagcgcgagcaactcgtcgaggacttcgccgtcttcgccgagcaggcctccacggggacggagggcggagccgggctgtccggggacgacacgctcgaactgggcgcggacgtgcgggcgatgcacgaggccgagcagtcgctggccatgcaggccttccgcagccttcccgagcggtggcaggccgtgctgtggcacaccaccgtcgaggaggcgtcgccgagtgcgatcgcgccgctgttcgggctgagcgccaacgcgaccgccgtactggccagtcgggcccgggaaggtctcaaacaggcctatctgcaggcccatgtgagttcggccctgggtgagggcggcgactgcgcgcggtacgcggaccggctgggcgcctatgcccggggcgggctgcggatgcgggcggagcgggggctgcgcaagcacctggaggagtgcgtgaagtgccggctggctgccggcgagctccaggacgtcaacgcgggcattccggcgctgcttccggttgcggtcatcgggtggttcgccgccgggtacgcgggcaaggccgccggggtactggccggcggggccgtcgccgcgggcggggccggggccgcggccgcggtcggcgggtcgaccgcgggagccgggaccgccggggccgcgggtggcaccgccggtgccggtgccggtggtggggccgcgggggcgggcagcgggtccgggggttccgtggccgccgaggggctcgggctgccggccaaggccgccatcgccgccgggatcgccgtggccgctgccgccggggtggtgttcgcgctgtccggggacgacgccgagccgcgggtccgggcgaagcccgcgcccagtgtggcggcgccggccgtgccgtcggtgccgaaggctcccgccccgtcctcgtccccggccccggccgagccggatccgcccgcgcaggagccgccggcggcgcagggctccgtagcgccgcggcccggaccgacgccctcggcggcggcttccgccgcgcccgcgccctcctcgtccccgtcgccctcccccagccgggagaagcccacgcccacgcctccgccgaagccgacagcgacaccgacaccggcacccactccgccgccgaagccgccgcaggggttccagctggccgggctcccccagtcggtctacggggaccacaggggcccggagctgcagacctggcgcagcggctgggtgtggcagcgccgcgggctggaggtgggcggccggcgcttcgcccacggcatcaccgtaaactcgcgctcctcggtggagatcaccctcaaccggcagtgcacgagcttctcggcgcgggcgggggtggacggcctgtccctgttcacggacggctcggtgcggttctccgtgtacgccgacggggagcgggtgtggcagtccgccgtcctcgggcacgaggacccgcccgcggcggtgcaggtctccctcgcggggcgcaagacgttgcgcctggtggtcgagaaggccgggccgggcagcctgccgaccctggcgagctgggccgacgccgtgctcagctgccgctgaacgccgtggtcagcgtcgcggcgaacgcggccggggcaagggcggcgccggcctcctcctcccggctgtagcggtccgggccgagcagggcgcgggtccgctccgggaggccgtccacggcaccgctctccggaaccgagcgcggatggcccgcgcgccaggcggtggcggccgcgagggcccgtacggcttcggccggccggtcggcgtcggccagcagcagcgccgccgactcggccatgccggccaggacgcgctcggcgcaccgggcgtcgacggcggcggcgagggcgggcccgatcctggccagaccggccaccgggccctgttcgcggccggtgaggacggcgtcgacggtggcgagcccggcggtgagctgggcgggcacggtgaaccgttcggcttcggcgtgggcccggtcgcactcctcacgcgcccgggcggcgtcaccgcgctggagggcgacgagtgcggagaggagccgggcgaaggtgctgacgtcgtacaccccgccgtaccggtcggactccttgccggcctccgccagcagccgctcggcgtcgtcgaggtcccccgcgcagtaggcggtctcggcgatccgggcgatcgcgaagggtgcctcgacgctggccccgacctcgcgggcgaggcgcaggcactcctcgtactcgacgcgggcctcggcgtaccggccgcgcgagagggcgacctccccggcggcgctcgccacctgggcgcgggtccagcggtcgccgacgcgatgggcgatcccgtgcagctcggcgaggtcggcgtcgacatcggcgaggccgccggtgacgtcgatgccgacgtgggcgcggagcatgaggacgatgccgagttcccattcccccgcgtggacacggcagttggcgacggcccggtcgaggtcggcgtggaagtcgagggaggtgccggtgaggaaggtcgtcgcgggccagagcatcccggggaagcgggtggtctccggtgagccgcgccggaaggtctccttgatgcgggcggcgaggtcgcggtagccggaggtgcggaacttctcggcggagttgctctccgcgagcaggaacatgtcgaggacgagcaggcgcatgaagcgccagtactcgggggtgccctccggggggacctcgggtgtgagcccgagggtccgggtggtccactcggcgccctcggcgcggtagttgcgcagccaccagaaccagccgagggcgaagacgaggcgccggcctcggtgtcggcggactcgacgacggtgctgtggagggcggcccggaggttgtcgagctcggtctcgacgcgccggatccacgggagctgggcggcggagcggatcaggggctcggcttcctcggcgaaggcgaggtagtgggcggcgtggcggcgggcggtggcccgggcgtccgcggggtgggcggcggcgcgctcggcggcgtactcgtggatggtttcgagcatgcggtagcgcatgccgtggtcggcggggacgccgcgatcgccgcgatcgccgtgacccggaccctgtcccggttcggccaggaccagggacttgtcgacgagggagccgaggacgtcggcggcgtcgtacggcgtgtcgtgggcggggtcggcgcagacggcttcggcggcggcgaggtcgcagccgcccgcgaagacggacaggcggcgcaggacggttcgctcggcctcgtcgaggagctcccacgaccagtcgaccacggcgcgcagggtctgctggcggggcaggaccgtacgggcgccgctggtcagaagccggaaacggtcgtcgaggcggtcggcgatctggcgcggggtgagcagccgcagccgtgcggcggccagctcgatggccagcggcagcccgtcgaggcgtgcgcagatctcggccacggcagccgggtcgtcgtcggggctgaagccggggcggaccgaggcaccgcggtcggcgaacagccggtgggcggggtcgggcggcaggggctcgaccgggcggaccgtctcccccgggacgccgaggggttcgcggctggtggccaggatccgtacgccggggcagtgcgtgagcagccgctcggcgagctcggcggcggcgccgatgacgtgctcgcagttgtcgaggacgagcagcaggctgcggtgggcgcagtgctccacgaggcgggtggtggggtcggcggcggccggggccggggtctcgcgggcgacgagggagctctcgcgcaggccgagggcgctgaggacggcgccgggaacggcggcgggctggtccaggcgggcgagctcgacgatccagccggcttcggggtgggccgcggcggcgtgttcggcaaggcgggtcttgcccgaaccaccgggaccggtgagggtgacgaggcgcaggcggcccagatcggcgcggagggcggccagttcgggttcgcggccgacgaaggaggtcaggcgggggcggaggttcccgcggggagcctcggggggaccaccgggaccaccgggaccaccgggatcctcggcgacctcggcggagtcggagccgacgggccgggactgcggggactgcggccgcggctgcggccggaggagttccgcgtgcagggcggcgagttcggggcccgggtcggtaccgaggccgtcggcgagggtgcggcgcgtgcgctcgtaggcggcgagggcctcggcggggcggccggcggcgcgcagggcgcggagctgctgcgcgcggaggctttcgtcgtacgggaactcgtgtaccagtgtctcgatctccggcaggagtgccgccggggcgatggcgcccccgcgcaggtccgcctcgatgcgctggcggagggcgcccgagcggcgggcctcggcgacggccgcatgggcggcgcgggcgggctcgggcaggtcggcgaaggcgggtccgcgccagagcgcgagagcggtgcgcagggtgcgggacgcggcggccgggtcggtggccagctcctggccgccctgcaccgcgagccggtcgaaccggtgcaggtcgatgtcgtcgcgggcagcggccaggaggtagccgccggtgggggcggagtggacggcgtcccggccgccgagggcgcggcggagccgggcgacgagggcctggagggcggccggggcgtcctggggcgggtcgtcaccccagacgtcgtcgacgagttcggcgacggaggccgggcggccggcccggagggcgagggcggccaggagcgcgcgcagccgggcgccgcccagggggagggcggcgccggtcccgtcgcgtgcctcggtgactccgaggatgagataccgcaccgggcaattctgcatggcccgttggggtggcggcggctccggccgggtctcaggtgatcgaggtgtccccgttgtcctccaggagcgtgcgcagggcctgggcgaccgtggcgcaggtcgcggggtccagcggggcgagcagctcggcgtagccgctcaagtgctccgtgatcatcgactccgtcagtgcgaggctccgttcggtcagccggatccgcaccgtacggcggtcctggccgtccctcacccgctcgaccaggcccttggcctccatacggtcgatgcggttggtgatcgcgccggaggtgaccatggcggccgggatgagggcgccggcggtcagcgcgtacggggggccggagcggcagagggtgaagaggatgtcgagctcgcccacctccaggtcgtgctcggcggcgaaggccttcagatgcttgtcgatgacgcggttcatccgctggatgcgggccaccacctcgaccggccacagaccggccgccagatccgggcgctccgccgtccactggccgacgatcgcgtccactgcgtcgctcatgcgctgttcctccatcgttcgcgtccctcgcacccccgccaggatatctcaacgttgagacacttgacgttgagaggcctgcgtgtttttatctcaacgttgagattctgagcattgagatggatcggagcgggcgccacccatgaccaccaccacggccaccaccgccgacatcacgaccaccaccggcaccaccgggatcactggcaccaccgggaccaccggcaccaccggcaccaccggcaccaccggcaccaccggcgttcgcccgaagcccgcccggctccgcgccggaacccgcgcccggggcggccccgttcccgtcctgtggctggcgctgttggccacgcccctggccgccggggccaacgcccccgtgctgatccttccggacatggcccgctccctcggggtgagcacctcgaccgccggctggctcgtcgcctcctacgcctgggccatggccgtcggcacccccctgctggccggactgctgcgccgccggggcctgcgcgcggcgctccgtctggccggtgccctcctcgtcgtcggcaccctcctcgtcgccgcgtccccctggctgccgctcaccctcgccgggcgggccacgcaggccgccggcggtgccggtctggcggcggtcgccatgagcctggccggctcagcccgccggatgggtgtgatcagcgcgggattcggcatcctcggcgcgtccggcccgctgctcggcgcccagctctcgcaggccgtctcgtggcggctctcgctctccgtatccgtcatcgcgatcctcgcggtacccgcggtgagccggtacgcgaaggctccggcggccaccccgcagggcgggttcgacgcccgcggcgcggccctgctgaccgcgctcgccaccgccctggtcctgctgccccgcacgccggccgccgccctcggctcggcggtcctcgccgccgccctgctcgcgctccacgtacgccggcgccccgacggattcgtcccggccgcgctgatccgcaagccgctcttcctcggctccgcactactcgcgctcgtactctcgggctcgtacttcaccctgctgttctccgtaccccggctgctcaccgaccgggcgggctgggacgtcgccaccgcgggcaccggtcagctcgtggcgctgctcaccggatccgccctctcctggctgctggccgcggcctcggcgcgcatgagccgggccgccgtccgcgcggtgctgatcggggtcggcgcggcggccgcggcgatcgcggtgttcgcgagctggggcccgctgctgctcgtcgccaccatgggcggggtcttcgcggcgaccggagccaacgccgtgctgtcgatgcacgccgcgtcgagcgcccccgacgcccagcgccccacggccatcggcctgttcgccctctgctaccagctgggcggggccttcggcccggcgatcgcgaccgctctggtcctcaccgtctgagccgcatccgtcggacccgggacgtcaggacagcgccgggcggtgcacggggactccctccggcaccgcccggcgccgtgccgcggaggtacccgtccagcaggtgccgcgccgggccagcaggcggccgagccacagctccatcgagaccagttccgccagcccgtccagcgggaccgggcggccgtccgccgcgtcgagcagggcctggcgcacgacccgggcctcgatcagcccggcgtccgcgagcagcggcgacgcgaacaggtcgagcagcccgctcagtgcggcgcgcagccccagccgggtcgccgtctcgttcggcacgcggtccgtggcaccccagcccggcgggaactcccgcacccccgccgaggacaggacgctgcgcaggatcgcggcccgggctccgggctggacccgcagggactccggcagggcgcgggcggcccgtacgacctggttgtccaggaacggggcgtgcagccgctggctgcggacctccacggcctgctcgaagacccggtggtcggcggcgtggcgggcgagcagcgaacgggcccgggcctcccccggccgcagcgacagcggcgggcggccggccgcgaccgtcaggcggatcgatacttccgccagtgcctcccccgtgagccagcccgccgccggccccgggcgggaccaggtcagggcggcgagggaagcgtccaccgggccggaggatctctcggggaccccgccctcgcggagccgggccgcggcggcctccatgcccgcgcggtacgtcgtacgggcaagtctccgggccgccgagtacacggtgagcgggaccagcagggactccccggaggctccggaggcggaggccgaccgggccagcgcggccaccgggcgcagcaggtgccgtcgccggcggtccatcaggaggtcggccatgcgggccgggtgggcgtcgaggacctggcgggcgccgtggccggtgaagtggtcggcggaaccggcggccagccgccgccgctcgcgggcggcgaagaccagcgagggcccgggttcgtcggtgagcgggccgtcgagttcggcgtacgggagggcttccgcggcggcggccaccacgacgtggtgcaggcgcgggtcggccgcgatggcccgggcccgttcgagttcggcctcgcgcccctgcggggtggccaggtcgttgaaggtgacggccagcagccgcgccccggcgggactcagcaggctgcccggcgcccccggcaggccggccgccagcagcgccagcgtcgcggaggcgctgccgccggagaggtcggcgcccaccccgggggccggggcgccccgggcggcacgccggtcggcggggcccattccgggcacggggccgggatcgtacggcggcagggtgtcgggagcatgccgcggagccgtgagccgggcgcgcaccgcgtccaccaaagcttcccgtacgccctccaccgcgcgctcggcgtcggcctcgggggcggccaccgcaagcgaggcgacctgctcgtagccggtgatctcgcgggagccctcgcgcaggatgagcgcgtgcccgggcgggatgcgccggaccccggcgtacggtgtgccgtcgcccagtgcctcgggactgtccgggcaggccagcagggcggcgaggtggccgatgtcgagctgggcctcgatgaggtcggcgagcgggagggcggcggtggcgtaggccgtgccgctggcccagggggtgtagaagacgggccgggcgcccgcgaggtcgccgacgacggtgatgcggcggccggcctggacgacggcggtgtagctgccggaccactgggtgaggtggcgcagcgcgccgccgcgggcggcgtagagcgcgcgccgcagttcggcgtcggtggcgccgcagcagccgaggacggcgagccgggtgaaggggtcggcgggatcggcggtgagcgtgcggatctcgtcggggcgccagtcaccgacggcccagagggggtcggggtctccccagaggagctgcgcgccgacggggtggacggtgcgttccgcgtccacgcccgggtcgtccggatgggcggcgtccgcgaggccgccgtgcaggggcgcgccgccgtggccgtatccgccctggccggagccgtggccggagccctggccagggccgtgggcggagacccttccggccgtgccgaagctcgcggcgatactgctccaacccaccaaccagcgcaccgccgcctccccagcccgtgggcacatgaccggggcacaggcagcacggacagcgctgagggcgcgaccgcgggaccccgggtggctcggggtccatgctgccacgggacaggcgtgcgagagtggttaaagggggcgcacaagcaaacgaacacgccccggcaactcggtatttgacgttccgttcccaccgccccataggtcgctttcagccattcttcgggcgccggaagagccctcacgggccgccggctcccggcgcgggggcgcggtccgggaggcggaagccaccccccggaccgttccgccacccgcggggattgaggtagcggcatcccccgacccgcccggtcaggcagcgggtcgacccacgcaccgcacatcgaatcgccgggtccggggaccggccagagcgcacgggcgggcgcacggccacacggacggagcacgcgatgacacgtgcgccccggctccgggtccggggcggactgtgcaaacggacaacaatcccgccatacggaagtaagggccttaacgcttgggaggcggggaactacgctgggtttacgaaatgccgggcgcctatgccccggcggcgtctgcgttccgcgtgtgacgaggggtggcgcatgtccagggagctccgcgagcccaatgagaagctcggcgccgtcctcgccctcgcgggcatcagcaacgccgggctggcccggcgggtcaacgacctcggcgcacagcgcggcctgacgcttcggtacgacaagacctcggtggcccggtgggtgtcgaaggggatggtgccccagggcgccgccccgcatctgatcgccgccgccatcggcgcgaagctggggcggccggtaccgctgcacgagatcgggctggccgacgcggaccccgcgcccgaggtcggtctcgccttcccgcgcgacgtcggggcggcggtgcggtcggccaccgacctctaccggctcgacctcgccgggcgccgcggcggcggcgggatctggcagtcgctcgcgggctcgttctcggtggcggcgtacgcgacgcccgcctcgcgctggctgatatctcccgccgacagctcggtggcccgggaaccggcgggcagccggaccgcgcaccccgcgaccgccgcaccggcacctgccgacggcccggcacccggcacaccggcacccggcgccgcggtgtccgacgccatgacggccgaaggcccgacgacgaccggcagcccggccaccggcaccccgacggccggcacgccggccaccggcggcccgacggcaggcatctccgctccgctcgaccccgcggcgcggcactccatggtccagagccccgtatcagcgaccccctcggctcacgacgggccggcgcgcgaggcgacggcaccaggtccccggtccttcccggacggccgcacgaccggcccgatgacaggtctggccgggccgatggcaggcccgggttccggaccgatgacgggaccggcgacgggcccgccgtccaccgttgtgcccgcccagcccttacccgaaacgccgcgcgaccacggccagcgcgtgggtcacagcgacgtgtccaagctgcgcgaggccgccgaggacgcgcgccgctgggactccaagtacggcggcggggactggcgttcgtcgatggtccccgagtgcctgcgggtggacgcggcgccgctgctgctcggctcctacacggacgaggtgggccgcgcgctgttcggcgcgaccgccgaactgacccggctggccgggtggatggccttcgacaccggccagcaggaggcggcccagcgctactacatccaggcgctgcgcctcgcccgcgcggccgcggacgtaccgctcggcggctacgtcctggcctcgatgtccctgcaggcgacctaccgggacttccccgacgagggcgtcgacctcgcgcaggcggccgtcgagcgcaaccgcggcctggccaccgcccgcaccatgagcttcttccggctggtcgaggcgcgggcgcacgcgaaggcgggcgattcgacggccgccgggacggcgctgcgagcggcggagggctggctggagcggtcccgggagggcgatccggatccgacttggctgggtttctactcgtacgaccgtttcgcggcggatgccgcagaatgctaccgggacctgaaactgccccggcaggtacggcgcttcacggagcaggccctgtcccggcccaccgaggagtacgtacggtcgcacgggctgcggctggtggtgagcgcggtcgccgagctggagtcgggcaatctcgacgcggcgtgcgcggcgggcacccgggcggtggaggtggcggggaggatctcctcggcgcggacgaccgaatacgtacgggacctgctgcaccgcctggaaccgtacggggacgagccacgtgtggcggagctgcgggagcgggcccggccgctgttggtgacgccggcgtagaagtgcgccggcgcgggagtggcgccggcgcgggaccggtcttccgggggccgcgtggccgcgttgtcggtgccggggtgcagtatgcaggggtgggaggtgtcagcgtgggtggcggcgtggactgcgatgtgctggtgatcggcggcggaatcgtcggcctgtcgacggcgcatgccgtggcgcgcatggctccggggaccagggtcgtggtcctggagaaggagcccggcccggcccggcaccagacgggccgcaacagcggggtgatccacagcgggatctactaccgcccgggttccctgaaggcgcgcttcgcggtgagcggggctgccgagatggtcaagttctgcgcggagcacggcatcgcgcacgaggtgacgggcaagctgatcgtcgccacggagcgggaggagctgccgcggctgcacgccctggtccagcgcggccgggagaacggcattccggtgcgcgagctcggcccggcgcagatcacggagtacgaaccggaggtgcgggggctggcggcgatccacgtcggcagcaccgggatcgtcgactacggccgggtgagcgcccagctcgcggagtcctcgggcgcggagatcgtctacggcggcgcggtggacctgatctcccggcgcgcgtccgcggtggccgtgcgcaccacgtccggcctggtggtcagggcgcgggtgctggtgaactgcgcgggcctccagtgcgaccggatcgcccgcctcgccggcgacgacccgggtatgcggatcatccccttccgcggtgagtactacgacctcgcgcggccggacctggttcggggcctggtgtacccggtgcccgacccggcgttccccttcctcggggtgcacctgacccggggcatcggcggcggtgtccatgtcggccccaacgcggtgcccgcgctggcccgcgaggggtacggctggtcgaccgtgcggccccgggacatcgcggacgagctcgcctggccgggatcctggcggatggccgcgcggcactggcggtacgggacgggcgagatccaccgctcgctgtcgaagcaggccttcacccgggcggtacggcgcctgctgccggccgtcacggccgcggacctccggccggccgcggccggggtccgggcccaggccgtgctgcgcgacggcaccctggtggacgacttcctgatccgcgacgccccgcgcacggtccacgtcctcaacgcgccctcgcccgccgcgaccgcttcgctcccgatcggccgcgagatcgcctcccgggccctgcggaccctcggctcggcctgagcggacccggagcccggggcgacggccgggccgacggccgggctccgcccggagccggggcgcacacgccggacgggctgacatgcgcccgtccggcgtttgagggcggccccgacccccgtcgtagaatcacggcattgtgtctgagtccctgaacccccagtcgccccgcctcccggacgccgcgccggaggcgaactcgtacgtgccgcccaagtggcgcaccgagccccgcttccccgacgggccctcgccggacccggccggctcgcaccacgagcggcggatccggagcttccagccccgccgcagccgggtcaccaccgggcagggcgaggccctcaagcgcctgtggggcacctggggcctggacatcgacggccaccgggtcctcgacctcaaggaactcttcgacgggctgccggtcgtcctggagatcggcttcggcatgggcgaggccacggcccagatggcagccgacgaccccggcaccgggatcctcgccgccgatgtgcacaccccgggtcagggcaacctcctcgccctcgccgagcgcggcgggatgaccaatgtccgggtggccaacggcgacgccatcatcctgctccgcgagatgctgccgcccgactcgctcgccgggatccgcgtctacttcccggacccgtggcccaaggcacgccaccacaagcgccggctgatccagccggaattcctgacgctggccgccacccgcctcgcgcccggggccgtactgcactgcgcgaccgactgggagccgtacgccgagcagatgctcgaagtgctcaccgcgcacccggacttcgagaacacgcagcccgacggcggcttctcgccgcggcccgacttccggccgctgacccgcttcgagggccagggcctcgacaagggccacctcgtacacgacttgctcttccgtcgcacggagaactgacaaggtcaccgcgcgtgtcagaccggctcgctagggtcatggtgtgtaccgagagctccacctcgtgctcccacgtccgtccggcacggtccgcacctgcgtgctcctcgccctgctcgccgcgaccgggatcgccatcctcgaactcgtgcgggaacagaccggcacccccggcttcttcgtcggcctcggtctggccctggtaccggtggcgccgctcatggcggccttccggtggctgggccgggccgcgcccgcgccctggtcgcagctgctgttctgcttcggctggggtgcctgcaccgcggcgctgatcgcgatactggccaacaacttcgccaccgagtggatagccgcggccaccaccgacgcctcggccgcagatcacctcggctcggtggccatcgccccggtggtggaggagagcgccaaggcggccgccctgctgctggtgttcgcgttccggagacggcatttcaccggccccgccgacgggtttgtggtggcgggcttcaccgccaccggcttcgccttcaccgagaacatcctctacctcggcaacgccttcgtggaggacctggccgaccgcagcggcgcgctggaatcggtgacggcggcgaccttcttcgtacggatagtgctgtcgccgttcgcgcacccgctgttcaccgtgctcaccgggctgggcttcggcgtggccgccgtcagcggccgccgcccgcgccggatcggcctgccgctgctcggcctggtgctggccatgggcatgcacgcgctgtggaacggttcctcgcagttcggggatcacgggttctacgtggtctacagctgcgtgatggttccggcgttcgggctgctggtgtggctggccgtgcggataaggcgcaaccggttgcgggccgtcgagggggagctcgccctgtacgcggccgcgggctggctcggtcctgccgaggtcccggccctggcctcgatgccggctcggtcactggcccgctccctggcccggcgctccgggggccgggccgccggacgtacggtcgcccgctacgaggcggacgccgcggccctggccctgctacggaaccgggcgcggcgcggcggccccgtacgggagccggatttcgcgggccgggaacgggagttgctgcaccggctctggcggtcgcgggcgacggcgggtccggcgctggcccgggcggcggtcatggaggagctggttccgccgtggttcgacccgctggacccggcggccgcggggaggtgcgtgcccgggccgcgacggacggacctcagacgttcagacccttggagttcagccacgccagcgggtcctgtgtcgacccgcccttgcgtacttccaggtggagatgaggtccggtgacgttgccggtggcgccgacgcggccgatggtctcgccggcgccgaccgtgccggaggtcaccgacatcgaggagaggtggcagtaccagatctccgtaccgtccgggagctccagcacgatccggtagccgtacgcaccggaccagccggccgaggtgatctttccggcggccacggccttggcgggggtccccgtcggggccgcgaagtcgaggccggtgtggtggccggaggaccacatggagccggagtcgccgtagtgcgaggtgagggtgtaggcggaggtggggagggagtagctgccggacggcttggcgaggcgctcctgctccgccgccttggccgccgccgcttccgcggccttcgcctcggcctcttccctggccttggcctcggcctcctccttggccttggcctcctcttcggcggccttgcgggcctcctccagcttctccttggcctcctgcgcggccgcctgccgggcggcctgctcggcctcggcccgggtcttggcgtcctcggcgtcctgctgggactccgcctgctggaggatgcggttgcgcagggcctcccccgcgtccgcggcggactgctgccgggtggtcgccgtccgctcgccggccgaggcggccgaggcggaacccgcgtcgtcctgctgggccttgcccccggtcatgatgtcggggagggcgggcagggatatcgcgacctggggccggtcctgcgcggtggcgatgccgccggcgccgaccgccgcgatcacaccgacgccgagcacggtggagctgcgggcaagtcccccgcgctgcttggcgacccggtgcttgccgcggacgggccgcaccgaatcctcggtggggttccactcgccccaggcacccgcggtgggcggctcctggatctcgatgccttcaggggcaggcaagttggaggccaccagggcacactcctcatcgacgcgcgggacgcgcgcgcgcacggtgccgtctcttgcgacggctgggacgaccgcgctgcgttatcgaaaggtaatagacgtaggggagtgattccaagctcatccgcttgatcgttcctaccaatcggccacccaccgactggctttggccaccgcttattcctgcaaatcagcccaactcagggcaaaaatcaagcgactcccttatcacttcagccacaggccggaaatgacggtccgtcaatccgcttgcggagagcaccctttcgattaccgaccgtcacatcacgtcgccgcggggcaccaccggcacggtccgccgccgctcgggctcccgctcccccggccggcccaccgcgagcagcgccatgtcgtccgtcgccccgccgcccgtatgccggcgcacatcgctgctgagcgcgctgagcagcgcctgcggcccggggaagatccgaccgcgcagccgggccgccggatcgtagaagtcgcccgccccgtcccgggcctccgtcagcccgtccgtgtagagcagcagggtggtccccgccgggaaggcccactcctgcaccaggtccggccagccgcccagctcccccatgccgagcggcagggccggctccaccggggtgaggaccgccagctcaccgttcccgtgcagcagcagcggctcggggtggccccggttgagcagccgcagcacgccctcgcccggcgggacctccccgagcacgcacgtcgtgaacccctcgaccgcgtccaggctgtcgcgccgggtgccctcgcgggccagcgcccgctccagccgctgcgccagcgcctccagcgtgggctcggtgtccgccgcctcccggaacgccccgaggaccaccgcgacggcctccaccgcccccagccccttgccccgtacgtcgcccaccgcgagccgcaccccgtacggggtctcctggaccgcgtacaggtcgccgccgatgaaggcgtccgcctgcgcggcctcgtaccaggcggagacgtgcagccctccgatgcgctcggcgggcttgggcagcaccgcccgctgcgcggcctcggcgatcccgcgcgccgaggcgagccgctcgccgctgcgccgcaccatgcggttgatcaggagcgccagcccggccacggtcagtacggtcaccagctcggtcagcgcctcgaccttccagctggtgccgcccaggaggtgcagcaggaacaccgcgcacacggccaggccgcccgtcagggccgtcgcccagagagtgaacagcggggcggcgatcagcggggccgcggtgaagaacggggatccggtgaagctgggcggggtcagcacgtcgaagaccagcccgaggacgatcagcgcacccggcagcaccagcagtacgcgacgggtcacaccgctcccgcccgcacgcccgccgccgttgccctgccggcccagccccaccacgccgctctcctgccgcccggtccgtcgcacgggtccgggcccgccgcctgatcgcccctcaaggctgggggcatgggcatccgtacggcgacctgacggcggccggacgggtgagggaggcgtgacggaggcgtgacggagcggccgacggggccggacacgacgaaggcccggttcctggagaggaaccgggccttcgtactgagtagcggggacaggatttgaacctgcgacctctgggttatgagcccagcgagctaccgagctgctccaccccgcgtcggtaaacacaactctacgccatccggggggagcccttcaccaattaaccgccgggcagcccgcaaacacccatcaccgcaggtcaggagggcaaaaccggccgtggacgctcgtccgccagagcgccccgggcgcgggtcaggacgcgggtggtgctgccgtcgtcctcccgcacgtcccggacacgggtgaagccgatgcgctccagcaggaccagggaggccccgttggcctcggccacggtggcgtgcacctcggtcaggccgagggtgccgaagccgtacgcgacgaccgcctcggcgatctcggtgccgaggcccgctccccaggcctcgggagccagggcgtagatgatctcgtggccgtcgacctcgtcggtccgcttgatctcggcgtgcccgaccagccggccgtcgcggcgcacggcccacacgtcgaagaggttctcggcgtagaccttcgtgaagacccgcccgaagagcgcccggtcctcggcctcggtggcaggaccgtcccccatccaccgggacacccgggtgtcctggaagagggcgacgaagccttcctcgtcggcgggggtgtacgggtcgagcaacagccgctcggtacgcagaacaggcgtcatgccccgggacgctacccgctccgcccggcgcgttcaccgcattaaccgccccctccgcccgggacttacgggcctcaccgcccgtcgcccggtacggagaagcgccccgcctgccgggtcaggccaggtgtcccacctggtagccggccgcgtggaggcggtgcgaggagtcctgccgatcgtggagcaatggcggccgcgcggccccgacctggcgcttcccgcctggtccggtggcgtaccgtcccgcgaacgggccgcgggtccagccgatggcgccaccgacaccgcccaacccgcggtttcctcccctcacaccaccgcagcagcagaatcccgagtacgaagtccccatctccccggcaccggcaagtgctaccggtcgctcgaagaactccgcgccaaccaccggacgggccagaaggagttcctcttcgaccccgaccggaacgagctgcagaagtacgccgccgcactgaacgacccccgcaacaccgaggagtacacccgtggacgcgtcccagctcgccgaattgcgcaccatgtacgtcttcacccccatggaggggcagacctgggggcttacgtacgacagcctgaaagccaggctcctggagcgcgatccggacgagttcatccggatccaggagggcgggcagatccgaggctcggccatgcactacggcatcaccctcgacggcgaagagctcgaagggtacgcacgggtccagccggaaggcatctcgatcctcgactccaccgcccaggcggctgcgaacttcgtgggctggctccgggagcacgtcgtcccggaggatgtggcgatgacgttcaacaccgcgtggggcctggaagaggatctgcctgacgccgatgtccccgaagtgacacggccccggcttgtcgcagccttcttcgctcacctcgaagccaccggcctggaatgagcgcacagcggcgatgcagcagtctcgccgcgtacgaaagacgctggtcccggagatcgcccgggaggttcccccgatggggccgggcgagccgtgtctggccccttcggtgtatcagagcaggaacgacgcggcgccgcacgggccgacgtccgctcgggtgtgcagagtccaccgcctgaacaggcatgacggccatccgatcacgcaccggcccggaaacgactgagcgccccacctggccgaaaccgggtggggcgctcagtagcaggtcagaggggtcagcccccgcctgcgagcggtaggccatgtcggactcgaaccgacaaccaacggattaaaagtccgctgctctgccaattgagctaatggccctccaggtgctcaccccagagcatagccggaccgcgccggtcagccgatcgggtatcccccgaccggcctgtcgccgccgggtcggtggtgttccggacggcctcgggccggtccccgaaagggtgttacggggcgtcagcttccgggaacggagaaagggcccgtacggcacctgggtggcgtacgggccctttctcaggggttcagctcagctgtgatcagccgttgcgcttccagcgcggcttgtcgtcgcggcggccgccgaagccgccggtggagccggagccggagccggagccggacggacggtggtcgtcacggcggccgtacgggcggtcgccgccaccggagcggaagccaccggacggacggtcgtcgcggcggaagccaccaccggacggacggtcgccaccggagcggaagccaccggagggacggtcgtcacggttgaagccgccggagggacggtcgtcgcggcggaagccaccacggtcgccaccacggtcatcgcggttgaagccaccggacggacggtcgtcacgacggaagccaccaccggacggacggtcgccaccggagcggaagccacccgacggacggtcgtcgcggcggaagccaccacggtcgccaccacggtcatcgcggttgaagccaccggacggacggtcgtcacgacggaagccaccaccggacggacggtcgccaccggagcggaagccacccgacggacggtcgtcgcggcggaagccaccacggtcgccaccacggtcgtcacggttgaagccacccgacggacggccaccgcggtcaccgcggtcgtcgcgacggaaaccaccacggtcgccaccgcggtcgccaccgcggttgtcgcgacgctcgaagttgccgcggtcgtcgcgctgggcgcgctgctcctcgcggcgctcctgggcggcgatctcggcggcagcggcggcggcagcagcagcgacctcggcctcggcggcctcggccacctcggcgacagcggcctccgggtcctcgccgcgctcacgggcggagcgggcgacgaggcggtcggcctcctcgcgcagctcgacggcgcgacggctcaggcgctccagctgcttggtcagctcggcgacctcgcgctcggcctgcttggcggcgttgttcgcggagtcggcctggacctcggtcagcgaacgggcaccggtgatctcggcgacctcgggctcgaaggcgccggcgccctggacgatgtggcgcgaggcgtcgacgcccgcgtcctccatcaggcggaagatctggcggcgctggtgcggcagcgcgagggagacgacgacaccggacttgccggcacgggcggtacggcccgagcggtgcaggtagtccttgtggtcaccggccgggtccacgttcaggaccaggtcgatgccgtcgacgtggatgccgcgggcggcgacgtcggtggcgacgagcgcgttgacgtagccgtccttgaagtcggcgaggacgcgggtacgggcaccctgcgtcatgccgccgtgcagcgcgtcggccttcacgccggcctcgacgagctgctcggcgatgcggtcggcgcccagctgggtgcggacgaagatgatggtgcggcccttgcgggcggcgatggcggccgtgaccggcgccttgtccttcggcttcacgacgaggacgtggtgcgtcatggtcgtgacgttgccctgcgcgctgtcgacctcgtgcgtgacggggttggacaggtagcgcttgaccagcgtgccgatctcgttctccatggtggcggagaagagcatgcgctggccgccgccggggatctggtcgagcagctcggtgacctcgggcaggaagcccaggtcggccatctggtcggcctcgtcgaggaccgcgacctggacgttctccagggagcaggcgccacggttgatgatgtcgcgcagacggccgggggtggcgacgaggacgtcgacgccgcgctccagagcgtagatctggttgctcatggaggtaccgccgcagacgaccttcatcttcaggccgagcacgtcgccgtagggctggagcgcgtccgcgacctgcatcgcgagctcacgggtcggcgtgaggatgatggcgcggggcttcttcttgtccgtgtgaccgccggccagctgggccagggtcggcaggccgaaggagagggtcttgccggagccggtgcggccgcggcccaggatgtccttgccggccagggcgtccgggatggtcgcggcctggatcgggaagggggaggtgacgccgttctgggcgagcttgcgcacgacgccctcgggcagaccgaggtcgccgaaggtgatcgagggctcggcgtccgcgtcggcgtcgtcgaagtcgtcggtggagtcctcgaaggacccgtctgtgttcacgtcggcctcaagagcctcgatgatctcgtccgcctcggcggcctcgatcgcctcggtcaccacaagggcctcggcgtcgatgatctcgttggagtcgttctcgggcatgacggaacggtcagagctggaaatggacatgcgaaatgcgaaaccttccggagtctcggcacgcgcccaaactccgtgaatcgcaaatcgaccgcctcaatgcggtcagccacggctagggagagtacgcgccacacggcgctcttcggattcggcgccgggcaatgggatcaaacgatctataaccatacgcaccctcccgggggtctggcaagtcgctcccggagaaccgcctctgacctgcaaagacacccgaccggccgataccggaccgggcccgtcggcccccggccggatgcccgccgggcctagagttccggcgccgggatgacggtcggctccggctgcggactcgacggcgccggcgtgggttccgtcacagggggagtggtggccggcggcgacggggtcgggctggccgaatgctgcccgccggccgaaccgcccgggccgccggatccgcccgacccgctcgaaccgcccgaggcgggttcctgcgggccctgcccgcccgccccgccgcccggtcccgccgacggcgcgggcacgcccggcgccccgctcggcgcacccgggctgggggaggccccggtcgcgccggaggccttgccgtcctccttgggccggctgtcctgggcccccgtaccgtccttcacgccgtgcccgttgccgtggatcccggagctccgccccgaaacggttcccgcgcccgcctcggcgccgccgcggcggtctcccgaagcggcgggcccgggcttcgccgcgtcctcaccgacgctcatgcagccggccgtcgccgcgaccgcgagcgcggtgacggccagtcggagggaagcggacaactggcgcacgggggcacctccggagcctgagggtgaacattccgcatgagcgggtcaatgtgcccaactccctttgacccgtaagggacacgccctcgccggaacacccggggcgaacccctcggccgaccccctgcagccggccccctcggccgccccctcccaagggctcccggacgaccccctcagccgaggagctgccgcgccacctgcgacccgaggtgcaccgcgcccagccccaccagcaccgacatcaccacgttcgccgcggccaggaacccccggccgcgctcggccagccgcagcgtctcgtacgagaacgtcgagtacgtgctcagcgcaccgcacagcccggtcccgagcagcagctgcagccgcgaggaggcggcccccgccagcgtcgccccggccagcgaccccagcaccaggcaggcggtcgcgttgaccacgaaggtgccccaggggaacaggctgtccgggccgtccgggccggccagccgcccctgcaccgcacggtccagcaggtagcgcagcggcgcgccgacggccgcgcccgccaccacgagcagccagttcacctcggggtaccccccggtgcgcgcccggcaccgcggaccgcgcgccgggtcgccgcggccgccgcccacaccgcgccgagcgccgccaccaccgtgagagcgccgtaggccagggcggtcccggtccgttcctcgtccaggagccgtgagaagtccaccgcgtaggtggagaaggtggtgaagccgccgagcacaccgaccccggcgaagggcctgagcagcggatgcggggccgtccggccaccctcgctgatcagcaccatgaggacgccgatcagcgcactgccggaggcgttgatccacagggtcgcccacggaaaggccccgggcccggccggccacagcagggcgatcccgtaccgcgccgcgcccccgaccgccccgcccgccgcgaccgccgcgagcacccggccctggggctcggcgcgctgcgccggtacgtgcaggtcgacgtccggatcgatggcctccgcggcatccgccgcccggaccgccccgtcaccgggaaccgggacggcgggcccggtcacccgtaccccagcgcgtgcagccgctcgtcgtcgatcccgaagtggtgggcgatctcgtgcaccacggtgacctccgtctcggcgaccacgctctcccggtcctcgcacatccgcaaggtggggttgcggtagatggtgatccggtcggggagcaccccggcgtaccactcgccgcggtccgtcagcggagttccctcgtagaggccgagcagttcggggtcgtcggcgggcggttcgtcctcgacgaacaccgccacgttgtccatcagccgcgtcagctccggcgggatccggtccagggcctctgcgacgagctcttcgaactcctcgcgcgtcatctccagcacccggccattgtcgctccgggggaaaccgttttggcgatagctccccggatcccatatgcttctcacgtccccgacgcgctgagaagtgcccggcgggcctttagccctcatcgtctagtggcccaggacgccgccctttcaaggcggtagcacgggttcgaatcccgttgggggtacgcattaccgtgtgcaagacttgttctcgcacactgcaaggtcctgtggagcagttggttagctcgccaccctgtcaaggtggaggtcgcgggttcaagtcccgtcaggatcgctgaagccggaaacggtttcgtggctgggtagctcagttggtacgagcgatcgcctgaaaagcgataggtcgccggttcgaccccggccccagccaccatcaagaaggccccgtccctcggacggggccttctgtggtcactccccttcggcctcggcctccgccacccgctccctgcggcgccactgcacgacgccgacggccgccgccccggccgcgaccagggcgagcagcaccccgtccggcaccgcgtccgccagcgagccgacccactgctccaccgcgaacgagtcgtccacgtccagcagccccggcagcgcgctcgccccgtcgtaggcgaggaacagcgcgcccaggacgatgaagaacagtccggacagcagcgaggtggtgtgcagctcgaagcgtccgacgcgcagggcccgcccgcgcagccagcgccgccggcccaggtcgaaccgctcccacagcagggccagtacgaagaggggtacggccattcccagggcgtagaccgccagcagcaggccgccgtagacggggctgccgctgaccgccgcgacggtcaggacgctgcccaggatcggcccggcgcagaacccggccaggccgtagaccgcgccgagggcgtacaccgacagggcggtggtcggccggatccggcccgacagctccgagatccgcttcggggcgaagccgaggcccaggatctgcgcgaggccgagcgcgacgatcagccagccgccggccagcacgagctggtcgcggttgctgtggaagaagcgcccggcgtacgagcccgccgccccgagcggtacgagggtgctcgcgaggcccgcgtagaagatcccggtacgtgccaggagccgcgaggtggagtcgatggagtacgcgaagaaggccggcagcagcagcgcgctgcacgggctgagcagcgcgaggaggccgcccagcagggcggccaggtatccgatgtcggtcaccgctgcgccgcctcggccttcgccctggcgatggcggccgtgaaggtgtcgagcggctgggccccggcgatgggacggccgttcagcaggaaggacggggtggaggtgacgccgatgcggtagccctcctcctggtccttcttcagggccgccgcggccggcccgcccgccatgtccgccgcgaagcgctccagatcggggaccccggcctcccgggccagctccacgagccggtgttcggcgaagcccttctccttcgatccggcggcgtaggccgcggcgtggaaggcgtcgaagcggtcctgctgcccggccgcccaggcggccctggccgcggcctcggactcggtgccgaagatcgggaaattgcgccactcgatgcgcagggtgccgtccgcgacgtacttcttcaccagttcgggctcggtgtcccgggcgaacttgccgcagtagccgcatttgaagtcggagtactcgatgaggacgacgggcgcgtcggcgcggccgacggcgagcttgtcgccggactcgcggcgggccagcgccttgagctcggcggcggggtcggtccggggcccggccacggcgggggcgccggacgagccggtcccggcgggggcggtggcctgccaggagacgatgccgagggtgatcgcggcgaggacggccccggcggagatcagcaggggcttcgtggcggacttcttggcggaggacttcttcttggaagagggcatacgggtgctcctgtgctgcgggtggcgggtcgggggcgggatggcgtccgcctcctagacccgcatcacgcacagctccaccgggtcgggcgccgggcgcccggggtcgcgtacgagggtgcttacgggcccggcaccggccggaccggcctcctcgggcaccggccgcacgggcgggacctgcgcgtgctgctcgcccgcggtgcgggtggggacggcgggtgtaccgccgtgcccgggggccgtcggcgcacaggcgggcccgccgccgtcggtgaacgcggccgcccggggccggaccggggccgagccggagtccgcggccgtggccgagcccgggtccgcggccgtggccgtagccgagccggagtccgggaccgaggccgaaaccgaggccgggacggccgccaccgccggtgccgcgcagcccaggagtaccgccaggaccacgccgagcaggctccagacgtgccgggggcgggacaaggtgggctgcctctcactcgtacgaccgacggactcgtcccgaaatggtacgggtccacccgacaaatgcgttcgccacccgtagggcccaggtgagatcctcgatcaggtatgtctacttccttcgccgccctgcagacgcttctcggtgagatctccctccgtgacgcgcaccgcctcggccgccgcctcgaaggcgcccgccgtatccgcaagcccgaggccaagcaggccgtgctcgacgagatcgccgcggaggccgccaaggccgccgagcgtctggccggccgtgcctcgcggatgccggaggtcacgtatcccgagaacctgcccgtcagccagaagaaggacgagatcgccgaggcgatacgcgaccaccaggtcgtgatcgtcgcgggcgagaccgggtccggcaagaccacgcagatccccaagatctgcatggagctgggccggggcgtccggggcatgatcgggcacacccagccccgccggatcgccgcccgcacggtcgcggaacggatcgccgaggagctgaagtccgagatcgggcagacggtcggctggaaggtccgcttcaccgaccaggtcgaccaggacgcgaccttcgtgaagctgatgacggacggcatcctgctcgccgagatccagacggaccgcgagctgcgcgcctacgacacgatcatcatcgacgaggcccacgagcggtcgctgaacatcgacttcctgctgggctacctggccacgctgctgccgaagcgtcccgacctcaaggtcgtcatcacctcggcgaccatcgaccccgagcgcttctcccgccacttcggcgaggcgccgatcgtcgaggtcagcgggcggacctatcccgtggaggtgcgctaccggccgctcctggaggaggacgccgaggaggccggcgactccgaccgggaccagatcaccgcgatctgcgaggccgtcgacgagctccagtccgaggggcccggcgacatcctggtcttcctctcgggcgagcgggagatccgtgacacggcggacgccctgaacaaacggaacctccgcttcacagaggtgctccccctttacgcgcgcctctcgcacgccgagcagcaccgcgtgttccagcagcacaccggccgccggatcgtcctcgcgaccaacgtcgccgagacctcgctgacggtccccggcatcaagtacgtgatcgacccgggcaccgcccggatctcccgctacagccaccgcaccaaggtccagcgcctgccgatcgagcggatctcgcaggccagcgccaaccagcgcaagggccgctgcggccgtaccagcgacggcatctgcatccggctgtactccgaggacgacttcgacgcccgccccgagttcaccgacgccgagatcctgcggaccaacctggcctccgtcatcctgcagatgaccgccgccggcctcggcgagatcgagaagttccccttcatcgacccgccggaccaccgcaacatccgcgacggcgtgcagctgctccaggagctcggcgcgctggaggcgggcgagaaggccggcccggaggggaagaagggccagcggctcacccagatgggccgccagctctcccagctccccgtggacccgcggctggcccgcatggtcatcgaggccgacaagaacaactgcgtccgcgaggtcatggtcatcgcggcggccctgtccatccaggacccgcgcgagcggccctcggacaagcagacccaggccgaccagaaccacgcccgcttcaaggacgagacgagcgacttcctctcgttcctcaacatgtggcgctacgtccgcgagcagcagaaggagcgcggctcgtcctcgttccgccggatgtgcaagcaggagtacctgaacttcctgcggatccgcgagtggcaggacatctactcccagctgcgcacggtcgccaagagcatgggcatccacgtcaacgaggccgacgcgcccgagcaggtcgtccacgtctcgctgctggccggtctgctgtcgcacatcgggctcaaggacaccgacaagaacgagtacctcggtgcccgcagcgccaagttcgcgatcttcccgggctcctcgctcttcaagaagcagccgaagttcgtgatgtcggccgagctggtggagacctcgcggctgtgggcccgggtgaacgccaaggtggagcccgagtgggtggagccgctggcgcagcacctggtcaagcgcacctacagcgagccgcactgggagaaggaccaggcggccgtgatggcgtacgagaaggtcacgctgtacggcgtgccgatcgtggcccagcggaagatcaactacggccggatcgacgccgaggtctcgcgcgagctgttcatccgcaacgcgctggtcgagggcgactggcgcacgcaccacaagttctacgccgacaaccgcaagctcctcaccgaggtggaggagctggagaaccgggcccggcggcgcgacatcgtggtggacgacgagacgctcttcgacttctacgaccagaagatccccgcccacgtggtctcgggggcgcacttcgactcctggtggaagcacaagaagcgcgaggagcccgaactcctcgacttcgagcgcgagatgctgctgaccgagaaggcggccggggtcaccaaggccgactacccggactcctggcggcaggggcagctgaagttccgggtgacctaccagttcgagccgggcgcggacgccgacggcgtgaccgtccacatcccgctccaggtgctgaaccaggtcacggacgagggcttcgactggcagatcccgggcctgcgcgaggaggtcgtgaccgagctgatccgctcgctgccgaagccgatccgccggcactacgtgcccgcgccgaactacgccgggcgtttcctggacacggcggtgcccttgcaggagccgctgccggtcacgctggcgcgcgagctccagcggatggtcggggtcccggtctcggccgaggacttcgacctcacccggatccccgaccacctgaagatcaccttccggatcgtcgacgaacgccggaagaacctcgccgaggacaaggacctggaggccctgcgcctgcggctgaggccgaaggcccgccaggccctctccaaggccgccgcggccacggcggagcgggcgggcggggagtcggtggagcgcaccgggctgaccgactggacgatcggcacgctgaccaaggtcttcgagacccggcgggccggccagccggtgaaggcgtacccggcgctcgtggacgagggcgcgagcgtgtccgtacggctcttcgacaccgaggccgagcagcagcaggcgatgtggctgggaacccggcggctgatcctgctgaacatcccggtgaacccggcgaagttcgcctcggaccacctgaccaaccagcagaagctggccctgtccaggaacccgcacggctccatccaggcactcttcgacgactgcgcgacggcggcgaccgacaagctgatcgccgaccacggcggcccggcgtgggacgaggcgggcttccgcaagctctacgaggccgtccgcgcggacctggtggacacgaccgtgcgcacggtgggccaggtgcagcaggtgctggcggcctggcaggcctgtgagcgccgtctgaaggccacgggcagcctggcgctggtcgccaacatccaggacgtcaggacgcagctggcggccctcgtgccggccggcttcgtgacgctcacggggctgcgccggctggcggacctgatgcgctacctggtggcggcggaccgccggctccagcagatgcccaccggcgtccagcgcgacaccacgcgcatggagaaggtccacgagatgcaggacgagtacgcctggctgctggagcagttgccgaaggggcggccggtcccgtccgcggtcaccgacatccgctggatgatcgaggaactgcgcgtcagttacttcgcgcacgccctcgggacggcgtacccgatctccgacaagcggatcgtgaaggcggtggatgcggcggcgccgtgaccgtcgccccggtccggttcgactgcaccccctgagctgcggtacagtctgattcgcagccgccgagcggccgcaaatctaggacctgtggagcagttggttagctcgccaccctgtcaaggtggaggtcgcgggttcaagtcccgtcaggttcgcagaaacgtcagggcccgtatccctctggggatgcgggccctgacgcgttggcgggtcccggcgcgtcggcggccttgggggccgcccgggaccgccggggccacccgggcccccgctgcgcgtgcgtggggctcatggggcccgtagagcgccccggtcacccgtgaacgcttccgggccgcctacgcgccacccgcgggccgcccacgagcacgtcccggtccgccgcggggcagtccggtgccggtccgggtagcggtcccggcaccgctcccggtgccggtccgcgcgcccacgcgccgaccgcgggccggaatcccccgttcgcatgaggtgccccgcgatgcccgtcccctttacggggtgcattaccgggtatacaagagtgatcatctgtgacgggagtcaccgcatgagtttttgagactcatacttttatcgcacccatacgcccgctcgatagaatatgtgcaatggcacctactccgccggtgcccccgcgcgcatccgagacccgccctgacctgggcataaaaaagatcgcgctggacccggcggagtccagcgcgatcgcacggcatgggacctgttggggcaggtccggccgtatgaagctatgtaggtttcatcggattgggggacccgataaacccgttaaagcggggtgttaacgcgacctcaggcctcgctgcgctgctgcggaattcccgcgagcagtgcgcgaacctcggcctcgcggtaccggcggtgtccacccagggtgcggatggacgtgagcttgccagccttggcccagcgggtgaccgtcttcgggtccacgcggaacatcgtggcaacctcagccggggtcagcagcggctcggcatcaggggtgcgagcggtcatgagcggcctcctcgggagaaccgaaccatctcggttctttcctctaaattctgcaccttggcccgcgttgcccgaaatggacatacgcgggccgagtcggttataggacgaacggcttgtcctcggcactacaactacaccatccgtccagcctcgacggccaaaccgacggaattgccctccgaggtgttcatcagcggcggaagccgatggaccgtcccataacggacagtcaccccactgtgacgatcagtcacagagcgatcaggagtcgtcagaccccccgtagagtgcaatgccgagcattccgcccttagttgggcggaaggaaccctccccggactccttgtcctattttggcacgagggtaggggaagggcgcaagggtgtagttagtgcggtccgtcacgcttgggccaatggcccgtatcgggacgtaggtcctggtactacgtcccaaatgccacgatcaggcctctgatcagccagtattgactgatcgaccgataccggacgatacgtacgggaccctcttgggtgaaaccggccacacaggcccctttcggcctaattagcaaaaagccgctcccggaccgtccgccaccgctccgccagcccctcgtacacctcggccgcgccctccgcgtccccggcccgcagggccgcgatgcccgccgccaggtccgcggccgagcggtccgccgccagccgctccgcgggcagcgcgtgcagcagcccgccgtagtccagctcgaccatcgagcgcggatggaactcctccagccagctccccacctccaccagcccgtcggcgagcatcccgtacccctccgcgtcgcgcagggtccgcagcgcccgggcgagccgccgccgggcctgcaccatcggtgtgcggtagcgcagccgctcgcccggcacgtggtcccgctccccgtccgccaccagcacgaaccagcgcagcgggacctgccacaccccggtgcggatccaggggcgcgcgtccgggttccgttcgcgccagctctcgtagtcctcggcggcctgccggcgcgcggacggcgggagcgccgcgtcgagcaccgggcccgggaaccactcgacgagctcctggagggccagccagccgcggagccgggtgcgccacgggcagaccagcagcaccccgtcgaccaccgccgtgaaggcgtccgcgctctcgtgggccggcaccgccaccaccgggacccgcaccaagtccgacagcgaacggcgaagttcgtcctgggcggtcggggtcgcgccgcgccgggcgtagtcggcccagtgcgtgcgctcgggctcggcgaaggccgccaagggctcgtacacgcgcaggtaggaggcgtacgggacggtcggcgccgagcgcgcggacggcagcgggagatcggaggattcgctcacgctctcgtactgccctgccgcggcgccgggttcacctccggggcgctcccgccccctcgcgccacgggagtgtttcgatcctcggacaggtcacctacgcacggcccacaggtcttactctgctcccagcacgccctcccccacccgcagggcgggcgtctttccgccgcatctcttccatgggagtcaccaccgtgaccgaaatgaccgacggcgtcctgcacaccctgttccgttcggaacagggcggccacgagcaagtcgtgctgtgccaggaccgcgccaccggcctgaaggccgtcatcgccatccactccaccgccctgggccccgccctcggcggtacgcgcttccacgcgtacgcctccgacgaggaggccgtcctcgacgcgctgaacctctcgcgcggcatgtcgtacaagaacgccctcgccggtctcgacctcggcggcggcaaggccgtgatcatcggcgacccggacgtcctcaagagcgaggaactgctcgaggcctacggccggttcgtggagtccctcggcggccgctacgtgaccgcctgcgacgtcggcacctacgtggccgacatggacgtcgtggcccgcgagacccgctgggcgaccggccgctcccccgagaacggcggcgcgggcgactcctcggtcctcaccgccttcggtgtcttccagggcatgcgcgccagcgcccagcacctgtggggcgacccgaccctgcgcggccgcaaggtcggcgtggccggtgtcggcaaggtcggccactacctggtcgagcacctgctggaggacggcgccgaggtcgtgatcacggacgtccgccaggagtcggtgcagcgcatcctcgacaagcacccgggcaaggtcacggcggtcgccgacacggacgcgctgatccgcaccgagggcctggacatctacgccccctgcgcgctcggcggcgccctgaacgacgagaccgtcccggcgctcaccgcgacgatcgtctgcggcgcggcgaacaaccagctcgcccacccgggcatcgagaaggacctctcggaccgcgggatcctctacgccccggactacgtggtcaacgcgggcggtgtcatccaggtcgccgacgagctgcgcggcttcgacttcgaccgctgcaaggccaaggccacgaagatcttcgacaccacgctggagatctttgctcgcgcgaaggccgatggcatcccgccggccgccgcggccgaccggatcgccgagcagcggatggccgacggccgcgccgcgcgcgcggtctgaccccttcccggggcccttgggcacgcccgccggggtgcggcgagacggaactcactgcacttcggcgggtcgcccgccaggaaaaggttaaaatcgcagctgaccagcgaggacggggcgccttgttggttctgcaccggggcgcgtcatgcgggcggcgtaccgtatggccgcggaagcaggtaccgttaaacccctacggacggtctctccacggagagcccgctccgaaccatgaacgcgtgtcagactctggggccgtcgagccccgtcaccgagggggtcgagccatggggcgcggccgggcaaaggccaagcagacgaaggtcgcccgccagctgaagtacagcagcggcgggactgacctctcgcgtctggccaacgagctgggcgcatcgaccgtggaaccgctgcctgtcagcgagccggtcgaggtagacgacgacgaactggacgaggacgacccgtacgctcggtacgcggacctctacaacagggatgacgacgacgaggacgaagagtccgggccgtcgtcacagcgtcgcggcgcttgacgccctgaggcgtctgcacgacagacaaaagactgaaacccggtccagggcatcgccccgggccgggtttcagtgctgctcagctcgcgtaggaaccggtcatggtggcgccctcggcgtggtcgccgcggtccaggatctctcccgcgacccacgcgtcgacaccccggtcggccagcgcggtcagcgcgacctccaccgactcctgcggaacgacggccatcatgccgacgcccatgttcagggtcttctccagctccagctgctccacctggccggccttgccgaccaggtcgaagatggcgcccggggcccaggtcgaacggtcgaccgtcgcgtgcaggtggtccgggatgacccgggccaggttcgccgcgaggccgccaccggtgatgtgcgagtaggcgtgcacctcggccgtacgggtgagggccatgcagtccagcgagtagatcttggtgggctccaggagctcctcgccgagggtgcggccgagctcctccacgtggctctccagcgacatcttcgcgcgctcgaagaggacgtggcggaccagcgagtacccgttcgagtgaaggccggacgaagccatcgcgatgacggcgtcacccgtacggatgcgatccgcgccgagcaggcggtcgtactcgacgacgcccgttccggcaccggccacgtcgaagtcgtccgggcccagcaggcccgggtgctcggcggtctcgccgccgaccagggcgcagccggcgaggacacagccctcggcgatgcccttgacgatcgccgcgacacgctcggggtgcaccttgccgacgcagatgtagtcggtcatgaagagcggctcggcaccgcagacgacgatgtcgtccatgaccatcgccaccaggtcgtggccgatggtgtcgtagacgccgagctggcgggcgatgtccaccttggtgccgacgccgtcggtggccgaggcgagcagcgggcgctcgtagcgcttgagggcggaggcgtcgaagaggccggcgaagccgccgaggccgccgaggacctcggggcgctgcgtcttcttcacccactccttcatcagctcgacggcgcggtcgcccgcttcgatgtccacgcctgcggctgcgtagctggcaccggtggtcttctctgtcatgacaggagagagctttcgtgtcgttactgcgtgtggtgccgggccctgggagaagcctcaaagacagggcccggcgcaggttgagccagggctacgggcgacggagcgcgtcggcggcgtccgtgccgcccgcgagctcggactccagcagctgcttgcccaggagctgcgggtcgggcagctccatcgggtactcgccgtcgaagcaggcacggcagaggttgggcttctggatggtggtcgcctcgaccatcgcgtcgagcgagatgtacgagagcgagtccgcgcccagcgacgtggcgatctcgtcgaccgtcatgccgttggcgatcagctcggcccgggtggcgaagtcgatgccgaagaagcacggccacttcaccggcggcgaggagatccggatgtggacctccgccgcgccggcctcgcggagcatcttgaccagggcgcgctgggtgttgccgcggacgatcgagtcgtcgacgaccaccaggcgcttgccccggatgacttccttgagggggttgagcttgagccggatgccgagctggcggatcgtctgcgagggctggatgaaggtccggcccacgtaggcgttcttgaccaggccggatccgtacgggatcccgctggcctcggcgtatccgacggcggcgggcgtgccggattccggcgtcgctatcaccaggtcggcgtcgaccggggcttccttggccaggcgccggcccatctcgacacgcgagaggtagacgttccggccggcgatgtcggtgtccgggcgcgccaggtagacgtactcgaagacacagcccttgggcttcgcttccgcgaatcgagaggtgcgcagaccgttctcgtcgatcgcgatgagctcgcccggctcgacctcgcggacgaagctggcgccgcagatgtcgagggcggcggtctcactcgcgaccacccagccgcgctccaggcggccgaggaccagcgggcggatgccctgcgggtcacgggcggtgtagagggtcccctcgtccatgaagacgagggagaaggcgcccttgacctgaggcaggaccttggcggccgactcctcgatggtcaggggcttgccctcgtcgtcggtctgaccggcgaggagggcggtgaccaggtcggtgtcattggtggcggccacctgggtggcacggccgtcctgacgggggaggtcggcgaccatctcggcaagctcggcggtgttcaccaggttgccgttgtgacccagggcaatggagccgtgggcggtcgcacggaaggtcggctgggcgttctcccagacggaggccccggtggtcgaatagcgggcgtgaccgaccgcgatatgaccttggagcgagccgagagaggtttcgtcgaagacctgggaaacgaggcccatgtccttgaagacgaggatctgggaaccgttgctcacagcgattcccgcggactcttgtccacggtgctgcagggcatacagtccgaagtaggtgagcttggcgacctcttcacccggagcccagacaccgaagacgccgcaagcgtcctgggggcccttttcgccggggagcaggtcgtggttgagtcgtccatcaccacgaggcacgctcccgagtgtaggcgagatcgaccactggtccgaattggggacggccgggaaatgtcacagcacagagggtgaccgatccattccgtctcggtatccggaatgcccttgttgacaggcgcatgggcattcgtacaggctctcgccccatgcagcctctcggtgaccgaacggtcaccctcgtcgagcgccggcacgtggaccttgtccgtgtcgcgagcgccatctgtcgctgttctgcgtagtcacacgccgctttcgttctttcttttcccgtttcctgcctgatttctgcctgatccccggccgagcccgccccgccgtgccgcgcgccgtcccgcgccgccgggggcgggccgccgggccatgccttggagtacctgtgacctcgtacgaaccccagctgtcccggcgcgccttcggcggcgcggtcggcgtgagcgcggccgccgccgcggtggggctgggcgcctccccggccgccgccgccccggcccccggcgacgggcagaacgcgcctcaggaacgggagttccgggccgcgcggccccggccgtcccgccgcccgaacatcctgttcatcctcggcgacgacctgggctgggccgacctctcctcctacggctccccgcacatcaagaccccgaacctggaccgcctcgcccgccagggcgtccggttcaccgacgcctactcgggctccgcgacctgctcgccgacccgcttcagcctctacaccgggcgctacccgggccgtaccgagggcgggctggccgagccgatcgccgacaagtcggtgggcctggagcccgcgcacccgacgctggcctcgctgctgaagggggccggctacgccaccgccctgatcggcaagtggcacgccggctacctgcccgactacagcccgacccggtccggctgggacgagttcttcggcaacttcggcggggccctggagtactactccaagctgggcctgggcggcgagtacgacctgtacgagggcgacgccgagtacaaggacctgcgctactacacgcggatcatcaccgagcgcgcgagcgagtacgtctcccgcgaccaccacggccgcccgtggctgctgaacctcaacttcaccaccccgcactggccgtggatcgccgacggcgacaccgagcagagcgccgagatcgtccggcggatcaaggcgggcgacgggcgcgccctgtggcaccaggacggcggctcggtcgagaagtacaaggagatggtcgaggacctcgaccgctcgatcggcaaggtgctggcggcgctgaagcgttccggccaggaggaggacaccgtcgtggtcttctccagcgacaacggcggcgagcgcttctcgtacaactggccgctgtccggcaacaaggcctccctccaggagggcgggatccgggtgccgaacatcgtgcgctggcccgcccggctggacggcggacaggtcagccgcgtaccggtgttcagcccggactggacggcgacgctgctggagctggccggggcgcggcccgaccgggcccacccgctggacggcgtgagcctggccgggtacctgctgcgcggcgagaagcccgccgagcgggacctcttctggcgggtccggggcgagcgcgcgctgcgccgcggggactggaagtactaccgcggcaaggcgggcagggaccagctgttcgacctggccggcgacgtccgcgaacaggccgacaaggccgccgcggaaccggcccggctggcgcagctgcgggcggcctgggagaaggtggacgcccagctcctcccgtacccggcctgactgcctcccgggcgggcgtcactcggcggcggaggacgccttcgcggtcaggcccttgccgtcggcggcggtgagggtgagggtgcggccctcggtcttcgcggtgagcgggccgctgccgaacagctcggtcagcgtccgctcgagctcgccgaccgcgccctcgcaggctatccgggtcgaggtcagcggcccgaaggtgaccgtggagccgtcgacggtggccttggcgctgaaccggttgcagccgaggacgccgctcacggtgaagtccggggcgatggtgaaccgcgccttcccggccgcctcggcgggcacggaggccgcggtcccaccgctgaccagcgactccacggtccactcggtcgtggtgagcggggcgtccgtgaccgcgggcgccgaggtcatggcgatggtgctcccgtcggcggtcttcagggtgagccggtcgggtccccggtcgatcgccagttcgccctggaacagcttggcgaaggccgtctcgaactccatgtccgcgcaggccatggtggtcgaggcaccgggcgtgacggtcaccgcggaggtaccggcgaaggccgccaccgcggtgaagccgttgcagccgtagttgcccttgacctggttccggccgatgtcgaggtgggcgctctcgggcgcgtgcagggtgcggccgtccgtggtcagggactcgacggcccaggagcccacgggatcgggcagccgggctccgtgggcgtccccggtccggccgcagccggccagggcgaggacgacgacgagggccaggcccgcggaggcggggacgtgccggaaggtaggcatgcccctgggacggaccgggcgccgcagtggttccaccatggttgttcccctcagctcatcagcggcagcagcgccgacagatcggcccgttcgccactggcccgtacgtgcgccccgtcgagggccgcggcccattgcgtacggccggtcgcgagccggatccaggtcagcgggtcggtctccaccacgttcggcggggtgccgcgggtgtgccgcgggccctcgatgcactggaccaccgcgaagggcggcacgcggacctcgaccgagccgcccggtgccttgagagcgagcgcgtcggcgagcagccgggtgcaggcggccagcgcctgccggtcgaccgggatgtccagtccggcggcccggttcaggtcgtcggtgtggaccaccagctccacggtccgggtgaccaggaagtcggccagggtcatgtccccgatccacaggtccagcacgcgctcgcccggatgcgccgcgagcgcctgcgccatccgggcggcggcccgctcgtacagctcgggcagcggtgccccggtcagggtctccctggccgcttcggagatcttcccggccagcgaggcggtggcgaagggccactcgacggccgagagctcggcgacggccgcgggcggccgggccaggccccccgccagcgagtcggcgatccaggcgatgtgcccggcgagttcggcgacgctccactccccgagcccgctggggcgtgccagctgctcgggacccaactccccgacggcccggcagacatgcgcgaactgcgcggtgacggccgtacggatccgggcgggatcgtaggtacgcggcttcttccctcggggcggcatgccccgaccctactcgggccgcgggttccgccgacgacacgagcccccgaccgctggatccggtcgggggctcgtggcagaggcggtgggatcaggccagcagggccgggatcgtcgtctcgtgggcctcgcggagctcggccagcgggagggtgaactcgccctggatctcgatttcctcgccgtccaccacaccgatgcgggcgacgggcaggccgcgcgcaccgcacatgtcggtgaagcggagctcctcgctgcgcgggacggccacgatggcccggcccgcggactcggagaacaggaaggtgaaggcgtccaggccctcgggcaccacgatccgggcaccgttgccgcccttgaggcaggactcggtgagcgcctggattacgccgccgtccgacaggtcgtgcgcggcgtcgatcatgccgtcgcgcgaggcggagatcaggatctcggcgagcagcttctcgcggccgaggtccaccttcggcggcatgccgccgaggtggtcgtggacgacctgcgaccaggccgaaccgccgaactcctcggccgtgtcgccgagcaggtacagcagctggccggcctccgagaacgccatcggcgtacggcggttgacgtcgtcgatgacaccgaggaccgcgacgaccggggtcgggtggatcgcgatgtcgcccgtctggttgtacagcgagacgttgccgccggtcaccggggtgcccagctccaggcagccgtccgccagaccgcggcaggcctcggcgaactgccacatgacgtccgggtcctcgggggaaccgaagttcaggcagtcggagatggcgagcggcttggcgccggtcgccgccacgttgcggtacgactccgccagcgccagctgcgcgcccgtgtacgggtcgagcttggcgaagcggccgttgccgtcggtggccatggccacgccgaggttggactcctcgtcgatgcggaccatgccggcgtcctcgggctgcgagaggacggtgttgccctggacgaagcggtcgtactggtcggtgacccacgacttcgacgcctggttcggggaggagaccagcgcgaggacctgcgcgcgcagctcctcggaggtctgcgggcgggccagcttgccggcgtcgtccgcctgcagcgcgtcctgccaggaggggcgcgcgtaggggcggttgtagacggggccctcgtgggcgacggtgcccgggggcacgtccacgatctgctcgccgtgccagaagatctccaggcgctcgccctcggtcacctcaccgatgaccgtggcgatgacgtcccacttctcgcagatctccatgaagcggtcgacgtgctgcggctcgacgatcgcgcacatgcgctcctgcgactcgctcatgaggatttcctcgggcgagagcgtcgcgtcgcgcagcggcacggtgtccagctcgacccgcatgccgccggaaccggcggaggcgagctcggaggtcgcgcaggagagcccggcgccgccgaggtcctggatgcccgcgaccagcttctccttgaagatctccagggtgcactcgatgaggagcttctcctggaaggggtcgccgacctgcacggcggggcgcttggtgggcttggtgtcgtcgaaggtctcggacgcgaggaccgagacgccgccgatgccgtcgccgccggtgcgggcgccgtagaggatgaccttgttgccggggccggaggccttggcgaggtggatgtcctcgtgcttcatgacgccgatgcagccggcgttgacgagcgggttgccctggtagcaggcgtcgaagacgacctcgccgccgatgttgggcaggcccaggcagttgccgtagccgccgatgcccgcgacgacgccgggcaggacgcgccgggtgtcggggtggtcggcggcgccgaagcgcagcgggtccacgacggcgaccgggcgggcgcccatcgcgaggatgtcgcggacgatgccgccgatgccggtggccgcgccctggtagggctcgatgtacgacgggtggttgtgcgactcgaccttgaaggtgaccgcgtagccctggccgacgtcgacgacgccggcgttctcaccgatgccgacgagcatggcgtcgttctggggggccttctcaccgaactgcttcaggtggaccttgctgctcttgtacgagcagtgctcggaccacatgaccgagtacatggcgagctcggcgccggtgggccggcggccgaggatctcgcggatccgggcgtactcgtcctccttgaggccgagttccttccagggctgggaggcgtccggggtttcggtggcgttcttgacggtgtcgaggctcatgcgctgaccagcttcttcaggaccgaggtgaagaacgggaggccgtcggtgcggcccgtcccgatcagcggctcgaccgcgtgctcggggtgcggcatgaggccgacgacgttgcccgcggcgttggtgatgccggcgatgtcgcgcagcgagccgttcgggttgccgtccaggtaccggaaggccactcggccttcggcctccagttcgtcgagcgtgcgctcgtcggcggtgtaacggccgtccatgttcttgagcggtacggagatctcctggccggcggtgtagtcgccggtccacgcggtctccgcgttctccacccgcagcttctggtcgcggcagatgaagtgcaggtggttgttccggagcatcgcccccggcagcaggtgggcctcggtgaggacctggaagccgttgcagatgcccaggacgggcatgccgcccttggcctgctcgatgatggtctccatcaccggcgagaaacgggagatggccccggcgcgcaggtagtccccgtaggagaagccgcccgcgaggacgaccgcgtcgacctggtgcaggtccttgtcgcggtgccacagcgagaccggctcggcccccgcgaggcggacggcgcgcagcgagtcacggtcgtcgagcgttccggggaacgtgacgactccgatgcgagtggtcaccgtcaggcctcgaccttcacggtgaagtcttcgatgacggtgttggcgaggaacgtttcggccatcttgtggatgcggtcgagggcggcctggtcgaccggtccctccacctccagttcgaagcgcttcccctggcggacgtcggcgatcccttcgaagcccaggcgcggcagtgcacgctgcaccgcctggccctgggggtcgaggatctccggcttgagcatgacgtcgactacgacgcgtgccatcgggcactcccgtgtggtggttggtgcgaaggcggttccatcagcgtacccggccgaaatttctacgcgggtagatatcccggggccgggatcaccgggccgtttcggcttcaccaacgcttcgcaaaatccgccggaaaaccacgtgcccggcattgcggcgggacacgcggagagaattaactgggcttcgcaatgcaatgggaatcgcggtacaaaggaatcactccggattccggaggaaagttgcattgccccgaaacatccacacaggcgacatcaccgcacgtcagcaggtggcgacgtcgcacgaagggaccgatatccgtggcgcagcgcgtagtagtcacgctctccgacgacatcgatggcggagaagcggtggaaacggtcgggttcgctctggacggaaagtcctacgagatcgacctcaatgtggcgaacgcaaagaaactgaggaagggcctggcccccttcgtggccgccggccgtcgccagtcgcgttcggggaaggtcttcaagcacaccgccgtcgccccggacccggcggtcgtccgcgcctgggcccggtcgaaccagttcgaggtgccgccgcgcggccgcatccccaagaagatctacgaggcctacaacgcggctcactgagggtcgatttgccatgcacccccatccgtcggctagtgtgtggatcacgccgaggggccagaccgcaggtcaaagcctccgaggtcgtgcgggtgtagttcagtagcagaacatccctcttccagagggaaggcgcagtgtgcgattcctgtcacccgctctgcatcacctccggaccactgctgtggatcgggtagagtgatgcatgcattgcctcgcggcagtgcagtgcttgcggacgtagctcagttggtagagcaccaccttgccaaggtggatgtcgcgcgttcgagtcgcgtcgtccgctctgtatgaagaaggctccggtcattgcgatcggggccttcttcgtgtttccccgacttcgccaccccggcgccggcccctgacaaatgtcatcggcggcggtgacagcgcgcactgccggcccggtgccggcggcgcgagccttggatcatgactgacaccgtgatcgaagccgaaggcctgcgccgcggctacgcgggaggattcgaggccgtccggggcgtctccttctccgtggcccggggcgagatcttcgccctgctcggcaccaacggcgcgggcaagacctccaccgtcgaactgctggaggggctggccgcgccgagcgggggccgggtgcgcgtgctcgggctcgatccgtacacgcggcgggccgaggtccgcccgcgcaccggggtcatgctccaggagggcggcttcccctccgacctgacggtgaccgagaccgtccggatgtggggcggggtcaccaccggagcccgcccggcggcggaggtgctggaactggtcggcctggccgcgcggtccgccgtacgcgtcaaacagctgtccggcggcgaacggcggcgcctggacctggcgctggccctgctcggccggcccgagatcctcttcctggacgaaccgaccaccggcatggacccggagggacgccgcgacacctgggcgctcgtccgggagctgcgcgaccagggcaccacggtgctgctgaccacgcactacctggaggaggccgaggagctcgcggaccgcctcgccatcctccacgagggggaactcgtcctgtccggcagtccggccgaggtgaccgccacccgcccggcccggatccgcttcaccctcccggccggggtgaccgcctcccggctcccgctgacgctgcgcgcggcggccgacgggcagcgcgtggagatccgtaccgaccgcctccagggggacctggccgaactactggactgggcccgggagtgcggcgtggaactggccgggctcgacgcccggtccgcctccctggaggaggccttcctggagatcgcggagaaccgccgcaccgccggcggccgcaccgaggacacgaaggcggagacccgatgaacacgctcaccctgaaccccggccggctcgtcgcgctcggccgctcggaggtgaccctgctggtacgcaaccgggcggcgctcaccctggccgtcctgatgcccctgctgatggtgttcatcctgcgctcctcgctgagcggggccgacggcgccgaggccctcggcgaggccaccctgaccggcgggatcggcatggtgctgatcctcgtcgtccacatgaacctggtctccgcctacgtcgcccggcgcgaggagctcgtcctcaagcggctccgtaccggcgaggcgaccgacctggagatcatcgccggcaccgccctgcccgccgccgtcctggccctcgggcagatcgccgtcctcaccgtggccggggccgccgccttggacgtgcgcatgccgcgcagccccctgctgctcgtggcgggcgtcctcgcgggcatcgtgctgctcgccggactgtccgcgctggccagcgccttcacccgcactgtggagaccgcgggcctcaccacgctgcccctgttcctggcgaccgtgctcggctccgggctgttcttcccggccgactcgctgccggacctggcggcctcgctgtgcgaactgctgccgctgagcggggtgatgaccctcgtacgggccgggtggagcggcggctcggcgggcggggacctgctgggtgccgggctgaccgcattggcctggatcgtgatcaccgtgttttctgttcagcggtggttccgctgggaaccgcgccggtagtgcgagtcgggggacgggaaccgtgtcgaaaatgacggggtggtggaagaaccgcagcagtgcggggaaggtcgagctctacacgcgggggtcgttccatctcttcgtcctcctggagatcacgtccttcgggctgatgcccgtggccgccaccgccccttcgaggcccccggtcctgcttcccctcaccctgctgttcatggtctgcggccatgcggtgctgtgcggggtgctcacccacaaggcgctgcactgggtggtgggccggcgcgaacgccccacccggacggcggtggcagtggtcgtcacgacggccgcgtgcaccctggccgtgctcacgctccgggcgaccggacacatctccgaggctgccgtgacgccgacgctggtggcggggctgatctggttcgcctcgggatcgctggtcctgtgcctgcggtcggtgaagaggatgctgttcatccccgcggcggcggcggtcgcgacggggctggccgcactcgccctgggcacgccggccgccacggccctgggctactgcgtgggcatcctgctcggcagcctgttcttcggcgccacctgcggtttctcggcgtggctgctgagaacggtctacgagctggaccactcgcgcgaggtccaggcgcgcctcgcggtggcggaggagcggctgcggttcggccgtgacctgcacgacgtgatgggccgcaatctggcggtgatcgcgctcaagagcgagctggcgatacagctggcccggcgcgaacggccggaggcggtggagcagatgatcgaggtgcagcggatcgcgcaggagtcccagcgggaggtacgggacgtggtgcggggctaccgggaggcggacctctcggtggaactggagggcgcgcgcggggtgctcagcgcggccggaatggactgccgcgtggacttcccggccgggcggcgggccacggagctgccgcccgaggtccagtcggccctcggctgggtggtgcgcgaggcgacgacgaacatcctgcggcacggggacgcgcaccgctgcctgatccggctgaccgccggggagggcggctccgtgacgctggtggtggagaacgacggggcgcccgaggccccggccgggcctccgggctcggggctggccgggctgcgggagcgactcgccgccctggacgggacgttgcaggcggggttggtcggcgacggccggttccggctgctggcgcagatcccggaccgacgactgcaagaactggaggtgcgggcgtgagccccgtacgcgtactgctcgccgatgacgagcatctgatcaggggcgcgttggcggcgctgctcgcgctggaggacgacctgaccgtcgtcgcggaggcggcctcgggccccgaggcgctggcgatggcgcgggcccaccggcccgacgtggcggtgctggacctgcagatgccgggggcggacggtgtgagtgtcgccacatcgctgcgggccgaactgcccggctgcaagaccatgatcgtgaccagccacggccgtcccgggcacctgaagcgggccctggcggcgggggtgcgggccttcgccccgaagaccgtctcggcgcagcggctggccgagctgatccggaccgtgcacgcgggaggccgctatgtggacccggagttggcggccgacgcgatcagcgcgggggactcgccgctgaccgcgcgggaggcggaggtactcgaactcgcggcggacggggcaccgatagcggagatcgcggagcgggcctcgctgtcgcaggggacggtacggaactacctgtcttcggcggcgacgaagctgggtgcggagaaccggcacacggcagtgcgtctcgcacgcgagcgaggttgggtatagtagttctcgcgttacggcgcacctgcggacatagctcagttggtagagcaccaccttgccaaggtggatgtcgcgcgttcgagtcgcgttgtccgctctgtaacgaagaagccccccggtcctcggaccggggggcttctctcgtccctgcgtctctacgaccaggactggccggtgaggcgctcgaaggcctcgatgtacttggcgctggtccgggcgacgacgtcggccgggagggccggcggcgggagctcgcccttgcggtcccagccggactcgggggaggtcagccagtcgcggacgtactgcttgtcgaaggagggctgcgagcggcccggctcccactggtcggccggccagaatcgggaggagtccggggtcagcacctcgtccgcggcgaccagggtgccgtcctgcgggtcgaaaccgaactcgaacttggtgtccgccaggatgatcccgcgctcgcgcgcgatctcccgggcgcggctgtacacggcgagggtggtctggcgcagcagcgccgccgtctcggcgccggcggtgcgcgcgacctcctcgtaggagacgttctcgtcgtgctcgccgacggcggccttggcggccggggtgaagatcggggcgggcagctcggagccgtcgacgaggccctcgggaagggcgagcccgcagaccgtgcgggtctggttgtactccacgaggccggagccggcgaggtagccgcgggccacgcactcgaccgggaccatgtcgaggttcttgcagatcagggtgcggccggcccagtcggcgggggcgccggcgggcaggtcggtggagatgacgtggttcgggacgaggtccgcgagctggtcgaaccaccacagggagagctgggtcaggacgcggcccttgtccgggatctcggtgggcagcacccagtcgaaggcggacaggcggtcgctggcgaccatgacgaggcggccgtcctcgtcacggtagaggtcgcgcaccttgccggtgtggaggtggacgaggcccggaacctgaaccggctcgggcttttcgacgaatccggacacggggtctccctgtagatctgtatgaagcgcaccccgattctcgcgcaccggcggccccgtccgcggacaggggtccgcgctgcgggccggtcgcgggccggttgccggatcagtcgtgcttgcagatccggtcgaggagattggccgtggcccgctggacccgctcgtcgacgtggccggggcggtcgagcgccggggaccaggcgaaggtgccggaggcgaagaccagcgcgccgctgggcgcccggtagagggaggtctcctggtggcggcggtggccctcgctgtcgaggtacggggagtgcgccagcaggatccggtcctggtgctcggggagctgggtgcgcgggaagtagcggtcggcctcgcccgcgaccagtccgggcagctcgtcgttctcgccggcgccggtggagtcccagagccagtgcgtggcattgcgcacgatcaggggagcgggttcggggacccggcccgcgtactggatgccgagcagctgctgctccgggcggtcgacctcgcgccacaggctggggcggcccgggccgcgccgttttcggcaggtgaggagccggtcgtcgaccccggagggggacgggccgagctcgacctgccagtacatggtgttggcggagaggaagacgagcgaggtgccgtgccggcgggcgcgctcgacggtgcggcgcatgggggccgaccagtactcgtcatggccggggaagaccagaccgcggtagcgggtggggtcgacccggccggcgtgcaggtcgcgggtgtcggcgtaggcgatgtcgtagccgtagcgctcggcccagcggatgaagtcgtaggcgtggccgacgtgcagcggcaggcccgcgcccgcgtaggggcggtcgaaggacacggtgacggcggcgtcctgctcgccgagcagccggccctgctcgtcccaggcgtggtagaggctggcgccggtgcggccgtcctccgggtagaggttgtaggcctgccaggtgatgtcggggagcaggagcaggaggtcggcggggtggtcgtcgcggaccgtgaaggggatgtgggagcggtagccgtcggcggtggtgaggacggcgacatacgcgccgacgctccagtaggaggggacctggaggcgccaggacagccaccagtggtggcaggagacggtgcggtcggcggcgagcggggccggctggacgatgccggagagccgggggctggtggtgatcttggaggctccgtcgccgccgtagtggccgatccggtagacgtcgacggagaactgctggggcgggtcgacggtgatgtggaagtcgatggcctcgcccggggtcacgccgccggtggaggcgaagcccttgatctgccggtggacgtcgtcggcggtgcggggaccgccgttgccgcgggcgcgcgggatctggccggttccggcggccgcggcggccgggtccacgtaccagggcacgacctggccggtgtcgtcgaagtagagctcgcttccccggaaccagggcagggggccctgcccgaaggggtcggacaccgcgtgcgcgagcgcacctgactcccaacgccggatctggtccgcacccatgaccgctcccctccctcgcacccccgaacgggcgtacatcgcctcggggcgcggctcctggccgaaccgggacggtgatccgcgctgcccggtccaggtcctcccgccgcgaccggtcccagcacatcacataacgcacgcagtccgtcactgttcgtcgcgaattgacgggatcggaacattggcatccggttgcccgtacgagccgtagccctcccgggggcgcccctcggcccgcctcagaccaggcggaccggcttctccgggcggacgcccagggccgagagccagtcccgcagcggctccgggttcccgtcctcgaccaggcacagcacgcgcggcgccaggtcggagcggcggtcgccgcccaccagcaggacgggaccgtcgagccagtccagcccgggggcggccccggccgagtccacggccgcgcagcacaccatcgccgtgacgtggtcggccagcaggtcccggccgctgcgcggcggctggagcgggaacagcgggacggcgtccgcgccgcgcgccttcccggccccggcggccggtccggcggcccgctcctcgcgggccagctcaccggtgatccggccggccagcgcctcgccggccgcaccctcgccgccggggtccgtgaggtagcccagcacccgctccagggtggggccggtgaaggcgtccgcggcgggcgagggggagtcggcggccgcgagcgtggcggggcccgccgctccggccgctccggccgctcctgcggagcccggggaaccgggccgggtcgcggccccggcgcggccgttcggggcggcaggggccgccccgggggccgaggaggccggggcgggggatcccgcggggcccgccgtcagccccgccgggacggccagggcgtccagggcggcgtgcaggcgggccgcctccgtccgccacttgcggtccacgacctcctccggataggccgtccagtccaccggggaccagtccggcccggcctcggccggaccgccgtggaagagccgcgcggccagcagcgaggtcgcctcgtcgatcagcccgggctgctccagcaggtcacaggcggggcgctcgcccagccgcgaggtgaacccctcggccagccggtcccgccgggacagctcggtcagcgcggagaccactccggcgtccaggtgcgccggccagcggcccatccgccaggcgggcagcgcgacccgggtcagcagccggtcccagcccgcgtaggcgaggccgacctgctcctgggcgacgatgcgcagcccgtagtccacaccctgtgcacggtccgaggcggccgcggccaccccccgctccatctcggcggcgtccgtccggcacagccgcagcagcagccgggccggcggggagatccagccgaggccgcgccgggtacccacgtccacggccgcgtccaggccgcgcacgaacccgcgcgcgtcggctatgtccgggtgcgcggaagggcccgtaccggcgacgacgggcgcgaggaccgcccgcagctccgcgacgcgcatccaccacaggaagggcgagccgatcaccaggaccggggccgcgcccggctcggactccggcccggcgggaccggccgcggcgccgaggacacgggcggcgccacgccggtgggccgcgtggctgcggtcctccagccagctgtcgcagtccggcgtcagggctatcgcggagggggccggcacgtccatccggtccgccaggtcgcgcaccagccggtagagatcgggcgcggcggcctcggagagcggcaccgtcggggtcacggcggggccggcccgcagcaccaccgcggcgaaggcaccgccgacgagcagcaccagcgcggcgacggcgcacacgacgagggtcaccgcgggccaggggtcaccggccagccggcccgtggcccgggcggccaccaggaccacggcgagggcggcgggcagcagcccgacggccaaggccctgctgcgcacccgcagcacggccagagcgcgggaacgcgcggacggtgcgcccgcttccatgatcgaaccggttccggacacggccggacctcaccccctctgccctgcggcgacgttgctcactcccccactgtgacacccgccactgacatcgcaatgccggtgggccaagtgccggaatgcttggcatcgcaccctagttggggtccgcgcgggcgtcaggcagaccgggtgacgatcacccgatggaatggctttgggtaaaggtggatgctttcgaacgcggccggatgcagtcgcacgcggacacgcccgcgggcccgggcgcacaaggtgcgcaccgggcccgcgggtctgcggagccgctggtcagcgaccctcggccgccttggcggcgatgtccgtacggtgctgcgaaccgtcgagacggacgcgggccaccgccttatacgccttctcgcgcgcctgcgccaggtcggaaccggtcgccgtcaccgacagcacgcggccgcccgcgctgaccaccgcgtcgccctcgcggcgggtcccggcgtgcagcacgtaggcgtccggcccgtcctcggcggccacctcggccaggccctcgatcgggtccccggtgcggggggtctcggggtagttgtgggaggcgatgaccaccgtgacggccgcgtcctcacgccagaccagcgggggtacggcgtccagggtgcccttggcggcgcccagcagcacgcccgcgagcggggtgcgcagccgggcgaggaccacctgggtctcggggtcgccgaaccgggcgttgaactcgatgacccgggtaccgcggccggtgatcgcgaggcccgcgtagagcagcccggagaagggggtgccacggcggcggagctcgtcgacggtcggctggaggaccagctccatgacctcgtcgaccagcttcgggtcggcccagggcagcggggagtacgcgcccatgccgccggtgttgggaccttcgtcgccgtccagggcgcgcttgaagtcctgcgccggctggagcgggaccacggtgacgccgtcggtgatggcgaagagggagacctcggggccgtcgaggtactcctcgatgaccacccggtcgcaggcgagcgcgtgcgcacgggcggccgccaggtcgtcggtgaccacgacgcccttgccggcggcgaggccgtcgtccttgacgacgtacggggcaccgaaggcgtcgagggcctcgtccacctcctcgggggtggtgcagacgtagctgcgcgcggtcgggaccccggccgcggccatcacgtccttggcgaaggccttggagccttcgagctgcgcggcctcggcggacgggccgaagacggggatcccggcggcacgcacggcgtcggcgacgccggcgaccagcggggcctccgggccgacgacgaccaggccggcgccgagttcggtggcgagagcggcgacggcgccgccgtcgagggcgtcgaccgggcggagctcggccacctcggcgatgccggcgttgccgggagcgcagtacagcgcggagacgtcggggtcgagggacagagagcggcacagggcatgttcgcgggcgccgccgccgatgacgaggaccttcacgctgctcagcctagccgggacggggcggtcgccttcgtgcggccacccaatcaggaccggctactcgtttgtgtattcctccacaacggtggctccgagctcgcgcacgatcaggtcgtgtccggtcagggcgctctcgacgaggtcgggatcgtcctcctccgcaaagtcgtcctcgggggcgaccggcgggggcgcctgctgtacgggcggctgcggggcgggagccgcatgctggggctgctgctgcgacgggtactgctgctgcggcggggcctgcggggcgggggcctgctgctgcgccgggggcggcgggctgtaggcgggggcgggcgcggccggggccccgtaggaggaggagccgtacgaggagggctggaccggggccggggagccgccgccgatgacggcctcgatcttccagttgacctggaactgctcggccaggaccgccttgaggacgtcctcgctgccgctgctggcgaagttgtcgcgggctccgacattggggaagcccagctggagggtggtcccgtcgaagccggcgacctgggcgttctggctgagcaggatccaggtgaagcggcggcggttcttgaccgcctccaggacgcccggccacatcgcctgcacctgcccggctccggcggccatgccgggggagggcgcggcggccggggcggccgcggcgggggcggcgggggcggcggccggagccacgggcgcggaggcgggggccggggccgacgcggccgcggtgggccaggcacccgcggcgggagccggcgccgccgcggccggagccgccgcgccgggccaggcgccgggagcaccgctgccgggctgggcggcgccgggccaggcgccgggggccggggcggcgggagcgggggccggggcggcctggaccggctcgggcgcctgcaccggggccggagcgggcacgggggcggcggcgcgcgcggcggccgcacccccaccgggaccggcgggcgccatggcatgcgcctcgggcccgggcacgtaccccatggcgggcgcggcggccggcggcgcggcgaaggcggcggcgggcgggccgctgcgctccagccggtccagccgggcctggacggaccgctcgtcgtcgaaggcggcgggcagcagcacgcgggcgcagatcagctccagctgcagcctcggcgcgttcgcgccgcgcatctcggtgaggcccgcgttgaccagatcggcggcgcgcgacagctcggcggccccgaagacggacgcctgggcctgcatgcgctccacgacatcggcgggggcgtcgatcagccccttctccccggcgtccggcacggcggccaggatcaccaggtcgcgcagccgctccagcaggtcggcgacgaaccggcgcgggtcgttcccgccctccaccacccggccgacgacctcgaaggcggcggccccgtccccggcggcgaaggcgtcgatgacggagtcgatcagggacccctcggtgtaaccgagcagggaggcggccatggcgtacgtcacaccgtcgtcaccggcaccggcgagcagctggtccatgacggacatcgagtcacggacggacccggcgccggcgcgcacgacgaggggcagcacgccgtcctcgaccgcggcgccctcccgcccgcagacctcgcccaggtagtcccgcagggtgccgggcggcaccagccggaagggatagtggtgcgtccgggaccggatggtcccgatcaccttctccggctcggtggtggcgaagatgaacttgaggtgctccggcggctcctcgaccaccttcagcagggcgttgaagccctgcggggtgaccatgtgggcctcgtcgatgatgtagatcttgtagcggctggaggccggcccgaagaaggccttctcgcgcaggtcacgggcgtcgtccacaccaccgtgcgaggcggcgtcgatctcgatgacgtcgatggaccccggcccgttcctggccaggtcccggcaggactggcactccccgcagggggtgggggtgggaccctgctcacagttcagacaccgggcgaggatgcgcgcgctggtcgtcttgccgcagccgcgcggcccgctgaacaggtacgcgtgattgacccggttgttccgcagggcctgcatcagcggggcagtgacatgctcctgcccgatgacctcggcgaacgactcggggcgatagcggcggtacagcgcaagggacgacacgtatacgaggttatccgggcccaccgacatcagcggcccgccgaagccccgggaggccgtcccggaccgcgctttgaccgcgcccggaacgcaaggcgccccccacgcacccgccagagcccacttacccttgctgccttccggccctgggggagttgggtgagatagcgccacgtgaggggctggccccaccctagcggatggaagcccccggaatcgagccggaccccgacctgcccccggcgcgacgatcacgttcgcgagcacccctcaacgtcttgtattgtttgcggcggaggattcgcctagtggcctagggcgcacgcttggaaagcgtgttgggggcaacccctcacgagttcgaatctcgtatcctccgccagtgcctcaccgggcacttgaaggccccgaccgggaaaccggccggggccttctgcgttccgtggtctcacttttggtctcagttcgcccgcagacgtgcatgccgaggccgctatccgtcaccgtgtgacccgaaccacgcacccagagctgcacgaggggaacgaaggtgtccgaggaaccgcaggtgcacttcccgcctgtcgaaaacgggatggactacctgatcagcgtgatggagcacctcgacggggccccaggccctcgcagcctgaagtacgccgtcctccatctgcaggccgcgacggaggtgcttctcaaagctcggctgatcgccttcgactggcggctgaccttcaagagggcggaggaggccgacagggccgccttcgaccgcggcgggttccaaagctgcaacgtggacacagcgatcaagcgtctgcgcgccgatgccggcgtggaggtcccgtcagaggccaagggccacatcacgcacctcgcatcacagcggaaccgtctgcagcacttcggtctcaccgagccggcgctggcggtcaggtctcgtactgtgctggtgctggacttcctgctcgacttcgtgaaccaggaactccggcctcacctgtcaggggatgacctctccagcctcgacacacacatggggaccgtgcgcgagagcctgagccgagtggaggctctggtcacgtcgcgtatggcgaggatccagcccgagctcgacagcatggcgaggcacgtcgttcagtgcgtggcctgcggccagtgggccatggtcgcccacgagggcgcgacatcctgtctcttctgcggtgtgccgtgggagccggagcaggcagccgaggagtacgccgccgagcacctcggcgacagctggttctccatggtcaaggacggcggtagcccgcccaggtacacatgccctgcctgcgacggggaagcgctggtgcagagcgtccgggtcgccgccttcaaggaggaagaccggggcttctgcttccactgtggcgaggcgttccgaaacctcaccgaatgcgcgaagtgcggcacgttgatcgatggtggggagggcgccctccaggtctgtgagacgtgcttcgagtacgccatggcccggaactagctgcggaacctgcctggccgcactgccgatcatgcggacagccatctattcaggcccccattcgcccccttccggggcggtccgggcggggccccgctgcccgaaccgctccgtgttccacgtgggtccctcggcgtctcctggcccgcgtgcggtgatcgtgaggccgccggtgggccgcccgagggcccggcccactcaggcgctccctccgatcgagccttcctcgtcgacgcggcggatcaggcgagccctggtcgggtctgtccagccgtcagacccgaccgatgccgggttcgctgcggacaggaacgcctctgttcaggtggtcggatcgagctgttcggcaatgagtcggaggatgtcgggccttgtcatgcctgttcctctagcgagggaaatgaagtgtcggcatgcgtcgatgaccagggcctggccggaggcttcggcggtgacgactgcgccgcgtccggggcggagttcgatgagccgctcgtccctgaggatctggtagccgcgcaggacggtgtgcatgttgatgtccaaggtgcgggccaaggcgcgggcggagggcaggcggtcgcccctgcggagcttgccgtcggccatgctgcggcgtacggaggcggcgatctgctccgcgaggctctggggtgaggacgggtcgatggtgaccagcatgtcagggacctttgcgtccgtgagccaggagatcgttggtgagttcggcggcggtgccggcgtcgtcgatggtgatcacgaactgcttgccgcctgtcagggtgagccatagggcgtcaccttcgcgcagcgatatggagctgaggcccgggttccagcggtagccccatcccccgatctcagtgggccgggtccagcgggcggaggcgctctcgatgcgttcgaggggaaatcgccggcgcaggaagggaagcacagcggagccggcggtgacgccgtgggcggagacggtgacgcggatggctccggtcgccaggaaagccgcggagacgatcaggagccacagggcgatggccctgtgcggacggtcgacgaccgcgacgacagtcaggccgacagccgagacagcgccggtggcgagcatccagccgctggccaggaagcgatgccaaaccatgaccgggtgcgaagcggaagtgcggttcatgcccgcctccgggagacaagccagaccacagcgcccactgctgcaccgactgcgatggctacaggcagttggtagaggggcagttggatgccgtgtccgtcggaatcgccgacggcccgcatggcggcaaccaaggcgtaggcggtagcggcggacaggccggaggcgaagacggccagcgacctgaccgtcgtcagggccgacctggaggagaagcccgcggcgatggtgccggcggcttcgatcacgaacaacagcatgtattggccaagtgtcgtggcgggtgagctgtagccgtcggcggcgccgtcgagggtgaagtgggtggcgatcttgtcggggaacgagtcccggcgcagcaagaacgcgattgaggtggccattgccccgacgacgaagggcgcggcgactaaggccgcgcgtcgcgtgaggctggcaggcggcgcgggatgcgtcgacatcgacatcgatcctctctgcggatcaggtcactgaatttgtttgcatcgagatagaacaaacatatcggttggtgatccgcgtacccagggctgctgtcagctacacgcagctgtgagcacttggcttgatcgcctgacgtcgccccataaagaacgttgccctgtcatcgaacacttgtagctttcactcgtccatgatccacggttgcgatgagtaaccactggaacatcacgagaaacagggagctatacatgcacaggcgcacaagcgtcgccatcgccgccgtaaccatcctcggcctcggcagtgtcgtagcccagcaggccgtggccacacccgtagcgagccgggcgggttcgtccttagccgccgcgtccacggccgaggccacccaggatggtcgggccctcttcgaaggcctggccttcgcccagggcgacgtggcagcagagcttgccgaatccggcatgttcgtggacgtcgcggccctccgcgagaagaacagcaccgccgagcagaggcaggccgtatccggggtcctggaccggatacagagggagcagccgcagttcttcggctccttctcggtgaagctccgctccggcgacccgcgacaggtagaaagcggggtcgccgaggccggcaagatcctgcagtcgctggcatcctcgaaggcggccaacgccggcgacatcgggaccggaaccgctcagtgcgcgaccgtggtgctcgccgtcaacgtgctgatcgccgtaaacctcggcggcgcgatcaacgcggccgtcgccgtcaacatccaggcggcgggcaacatcgtgaacgcgctcaacttctggtccgcgcccggcaacggcgggagttccctgacgaaggaccagcagatcgccgggctgacgcgggtcctggcggcctaggcgcggcgcacagcggcgggccggcctccaaggcgcctggcggccggcccgctgccctcgtcctccgctcccgcaggccaccaggcttcgccgaccagtcaagggcacccccttcccatgcgtctcaccaacagaattcagctgcactcccactctcccgaccattcggtcacagtgccccgcatctgggtcacggcgaccaccgcggcctgggtcgtcatctgcctctacgtggcccagagcttcctgccgcacaacaccatctcccttcccgggcagggcaagacccggaaggtggcgaccgtggtggctccccagggctgggccttcttcaccaagtccgcaaaggaccctcagtacgccccctatcgcatgaccggcggtcagtggcacagtgcggcgctcaccccgcactccaggccgtcgaacgccttcgggctcgaccgcgcttccaggtcccagggcatcgaggtagccctgctgctccaccaggagaacgtcacgtggaccccgtgcgcggaaacgcgttcggtgacggactgcctgaagagagcagcagcccaggcaacgacgacgaccaacccctcgccggacccaaccctgtgcggacgcgccgccgtggcggagatgcggccggttccctgggcctggcgtgacctctcccctgagcctcacacccccgagcgcatcgctgtctgggatgtgacgtgcccgtgaaccagagacgcatcccgctgccctggaccaacgtctacggcctcgcccgcaccctcgttgccctgggcaccgccggaaccctggccgcatcgagtgccgaaaccctgttccggcccgtggccaccatcgggaactacccggcctgcacctccaccaccgcagccagcctcttctgcctttctccggacgactacacgcacctgacctggatcaaatgggcgtgcgtcatcgccctcttggtcgtcgcatcgggctggcgtcccaggctcaccgcactgcctcacgcctacatcaactacagcgtcttctctggcatcgcgatcgtcgacggcggcgaccagatcgccctgatcctctccgtcctgttcgtcctcccagccctcggggacaggcggcgctggcactgggcacaacctccagtccggacgccgcagacgcgcgccacccaactgctcgcgctcatcggtaccggcgggctggtcatgctgcgcctccagatgatcgtcgtctacttccaggccgccgtcgccaaactgcctcactccgaatggcaggacggaaccgccatgtggtactggggcaccaacctcgacttcggccccgccccatggcttgacacgctcatcgcacctgtcatcggcaccccgctcggagtggcgctgatgacctggctccctctggttatcgagggctccctggccatctccctactgctgccgcagcgcctgcgatggtgggccatgggcgccggcctcctcttccacctctccatcgccctgatgatgggcctgtggagcttcgcccttgccatggccggaggaatcctccttctgtgcctgccactcggctccaccatccagttccacatcaccgaaccggcagtccccacaccctccacgcccgaacaagaggccgagccggtgcacgtcggcgagcaagccggggcggccgcacccccacggcgcgggcagatggacgaaacgggactcacacaaagtcggcagtaatgccgacagggagccgcacacgagggtgcgcacgccgaaggctgcgtcagcagctcgggaggcgaaggagaatccctatggccgaacgtccaatcctgcttttcgacggcgaccgcgacttctgcaccaaagccgtcaacaccgctgtgcgcccgctggacaccgacgccgacatcaccccctggcagttcgccgacctggagacactgggcgtcaccgccgaaaagccgaccgcgaggtcctgtggatcgaggccgacgctgccgtcgtgcacggcggcgcggaagcggtggcccacctgctgaagcagagcccgcaccgttcctggcggctcgcgggacaggccatggcaatgcccccgctcaactggaccgcccggctcgtgtaccgggccgtggccatgaacggccaccgcctcccaggcgcaacggcagcctgctccctgcccgcccatctgcggcccgcgacccgtgacggcgcctgacaccacactcgggcgggcttggggtcacagccaccaggccgatcacttggtagccggtctcggttctggtctcattcgcctccgtccggggctgttcggacggggccgagttggaaagcgtgttgggggcaacccctcacgagttcgaatctcgtatcctccgccagtgcctcaccgggcacttgaaggccccgaccgggaaaccggccggggccttctgcgtgtgccccggctgcggggtggcagggcctgttctggaccgacgcggccatcgcgctcgcctgtatccccgtcacgctgaggggcgtcgccgaatccaaggatccggatcgcagccgctccatcgacttcgcggggaccgtgctgatcgccaccgtgctcgccccggcgctgctcgcgctcagcgagggcgcacagtgggggtggacctcggcgcaggtcctgggctgcttcgcgctggcggcggcggccgctgtggcgttcgtcgccgtggagcgccgggtggaagcccccctcgtcgacctgcggttgctgaaaaaccgtgtgctgatcggagcgacgatcgggatcctgctgagcgcgggagtgatcaacggtctgatgtacctggtcagcctctacttccagaaccccgccacgctcgcgctcagcccgctggaggcgggtctggccacgctgcccgcgacggtgggtctgatcgcgatcaccccgctcgtgccccggatcgtccagcggctgggcatcggaccgtgatcgccgccggtttcgcggcggcgacggccggctgcgcgctgctcgtgttcgtccagggcgactggcggtacggggcgttcgtcctgccgctcgtgctcctggccaccggcctgggactcgtcaacggccccgcgagttcggcgtccacctcgaccgtctccgccgacgacgtcggcgcggcctccggcatctcgaacatggcgcggtacatcggcgcggccgcgttcacggcggccgtggcgacggtcaacgcgacggtgggggagtcccggagctcggccggggacccggcggcggacgcgctggcggccggcctgtccagcgcgtgcctgctgctcgcgatcgcgtccggggtgggcatgctgttgtccgccctcgcggtccgcgcgcgccgccgccgggtcgggcccggggcgtacggggcggccgccgccgcgcacgcccacaccgtccgcgtcggaggcggcgacgacctgtgaccggtgcgggaccgggcgggcctgacggccggacggcgccggacggtccggcgccggccgccgtgtcctcgtaggtccccgtccgcggccccggtccccgctccggccggtcggcacaatggccggatgacgagcgatgtgctcctgatacccgcccggccgaccaccacggccggactgctcgccgaggccgccgcccgccgggggatgaccgtccgggccctcggccccggcttcggcgagctggccggccgggccgtgcactggtgcggtggtccgcacgccgccgcgcgggtggccggcccgctcgggctggggctgctggaaccgcccgaccactggctgacgcgcctgcccgagcggttcacgggccgccggatcgagctgaccaccctgggccgggcggcgcgggagctgaccggatccgggcggccggcgttcgtgaagccgccgcgcgagaagtccttcccgcccgccgtgtacgggccggacgcgccgctgccgcggtccctgcccgccgccacccccgtgctcgtctccggggtggtggacttcaccgccgagtaccggttgttcctgctcgacggggagatcgccgccgggagccggtacgccgtccacgggcgcctggaccccgcgccgctcgacgaggatccgcgcggggccgacgtacgcgccttcgcggcctcgctgctcgacgcgacgggcgcgcagctgcccagcgccgtcaccgtcgacgtcggcctcctcggcgcgacgggccggtacgcggtggtggaggccaacatgccgtggttctcgaacagttacgccgcccggcccgaggccgtcctggacgtggtcctgcgcgccgccggcccgctccaccgcgtccgcgcagccgacctgccgttcgtgaccccctaggcagggggccgggggcgggggaggccgtcggccggtctcccccgcccgctcagccgttgaagccgagggccagggccacgaccgccggggccgcgtagatcaccgggaaggcgacgtgcgcgtacgacttcgcccgcagcaccgtgatcacggctccggcgaagtacagggcgacgccgatcgccgccgcgatgccgatggccggtacgaagacacccacgaccaggccgaccgcgcccaccgccttcgcggtggcgagcagggtccaccacgagcgcggcacgccgtactcgaccaggggctccacgacccacttcgccccgaggaacatcgaagccgccgagaacccgaccatgaacgcgccgaccagggcgaaaacaacagcggtggtggacatccgagctcccctcgggcgggcgccggtgcggactcgctccggtctgtctcccgcctgcttcactccactgacccgccccgcggcgccgatgtgacaggccgcgcgaaaaaacttcccgcccgcgctcagggccgggacctggttcagccgaagctcggcatctcacccaccgttgtcgacatgtcgatcaccgcgaaagcggcgccctgcgggtccgtgaccgccgcgaaccgcccgaacgggctgtccatcgggccgaagtgcagcttcccgccgtgcttctgggtcttcgacaccgcctcgtcgcagtccggcaccccgaagtagacctggatgtacggcggcacgtccggcgggaagtcgtcgtccatcttcatccggcccagcaccgggttcccgccaccgccgacgctgaacaccttgaagtccatgccggccatctcggggtcctcgcccgggtccatctgctggacgccgtaggggaagaccttcgacaggaacccgtccgccttggccgggtcccgcgtgaagacctccgcccacgcgtacgaacccgcctcgcccatcttctcgaagcccttgtgctcccccggctgccagacgccgaagaccgcgccgctcggctccttcgcgatcagcatcgtgccgaaggcgcccacctgcatcgggcccatcagcacctcgccgccgttcgccgtcaccttctcggccgtggccgccgcgtcgggcgaggcgaagtacaggcaccactgcgagggggcgtcggcccccggcatcggcgggaccacggcggcgacggccttgccgtccgagtaggcctgcgtgtagttgccgtactcgccgctggcctcgccgaaggtccagcccagcacgtcggcgtagaaggccttggccccttccacgtcggcgaacatcgcgtccacccagcacggagcgccctcggggaactcagacatgatcgatcgactcctcgtctcgtctcgtacctgtcgtcgtcgcagacggtcgtactcacgctaggcgcgcggtgcggcgaccgcgcggggagcgcgcccaggcgggacgctggagccatggacaaggacatcaccatccggctggcccagcagccggaggccgacgcgctgctcggccggagcccgctcgccgcactcgtcgggatgctgctcgaccagcaggtgccgatggagtgggcgttctcggggccctggacgatcgcccagcggctcggctccgacgatctcgacgcgcacaccatcgccgcgtacgacccggaggccttcgccgccctgctctccgagaagcccgccgtccaccggtatccggggtcgatggcgacgcgtgtccagcagctgtgcgcgtacctcgtggagcactacgacgggaacgcggaggcggtctgggcggacgtcgcgacggggcaggagctgctgaagcgcctcaaggcgctgccgggcttcggggagcagaaggcgcagatcttcctcgccctgctgggcaagcggttcggcgtgcggccgacgggctggcgggaggccgcgggcggctacgggcaggcgaacgtctaccgttcggcggccgacatcacgggcccggagtccctggccagggtgcgggcccacaagcaggagatgaaggccgccgcgaaggccgcgaaagccggcaaggccgcggacggctcctgatccgggtcaccaccgggggcgcccgcgcaccgcccccggtcagctcctggagcgccgcggaattgaccggccacacgggccgccgattgacccctgattccggtcgctcaagatcgtagattggtggacatgacagagatcgcgacccgcgccgccaccgccgaagccatctacgacggccccggcagcctcatcaccctgctcaccgacaccgacgagctcacctgcaacaccgccaccttcgacgagggcgcggcgggcgccccggtgcacttccacaccaaggccaccgagttcttccacgtcaccgccggccggctcgacatcctcgtcgacgacgagatccacaccctgggcgcgggcgacttcatcgccgtcccgccgggcgtgaagcacgccttcgccccggccgccggccacacggccgccgtgttcgtcggcttcacccccggcatgggccgcttcgactactaccggctcctcggccgggtcaacgcgggcgaggccaccgtgcaggacatcaaggacagctcggcgacctacgacaaccactacgccgagagcaccgtctggagcggccgccgccgcagcgcggagccgtagaccacgtccgcgtcgaggcggcgcagttcctccgcgatcagttctgcgccgctgcggatcttcagggccaccctgcggtcggggctccccggcaggctcagggtggccagcacacccgcgggccggtccacccggatctccccgcccgcggtctgcaggctgaccccggtgatcaccgggccctcgctcgccacccgggccaccggcacccccagccggtcctccagccagcgcgccagcagctccgcgctcgcgttgtcgggctcgctctccaccgccgcgccggtcaccggcagcggcttctggtccagggccgcggccagcagcgagcgccacggcgtcagacgggtccaggccaggtcggtgtccccgggctggtagcccgcggcccgctcgtcgagcacgccgaccgggtcgaaggcggcggccgcgtccgtgatccggcgctgcgcgagcgcgcccagcgggtcccgcgccaggtcggtgggcgcgtcggccggccaccaggccaccacgggcgcgtccggcaggagcagcggcaggacgaccgagccggcgtgctcggtcagtgccccgtgcaggcgcagcagcacgatctcgccggtcccggcgtcggatccgacgcgcagttcggcgtcgacgcggttcgcgcggagcttgtgcgagccgcgcgaggtccgcctgatcaccgcgatgatgcggcagggatgctcacgcgaggcctcggaggccgcgcgtacggcgtcgtacgcgttctcctcgtcggtggcgaggacaagggtcagcaccagccccatggtcgggctgcctatcgcccggcgtgcttcgagcagggcccggttgaccttgctggacgtggtgtcggtgagttcggtccgcatgcaccgagtctgtcaccgcgtcaccggcgcctgcgcgccgtcccgaagatcgagcgcgagatctcccggcccagctgggtcccgatcgaccgggccagcgagcggaacagcccgctccccaccacctgctcggccagcgagggatccggcttgggggcgctgcgcgcggcccgcgcggcttccttctccgccaccctggcctgtttctcggcctcggcttcggccgcggcggcctctgcccgcgcctccgcggcggcctgttcggcgctgatcttctcgtacgccgactcgcggtcgaccggctccgcgtagcgcgcccagagcggcgaggacgtcacggcctgctccaggtcggccgccgcgaccggtcccatcagcgactgcggggcgcgcagccgggtcgccgcgaccggggtgggggcgcccttctcgctgagcacggtgacgaccgcctcgccggtccccagctgggtgagcagctcctccaggtcgtacgcggagttggggaaggtccgcaccgtcgccttcagcgccttggcgtcgtcgggggtgaaggcgcgcagcgcgtgctgcacccggttgccgagctgggcgaggacgtccgccggcacgtccttgggggtctgcgtcacgaagaacacgccgacgcccttggagcggatgagccggaccgtctgcgtgacggaggcgaggaaggccttcgaggccccgctgaagagcaggtgcgcctcgtcgaagaagaagacgagcttgggcttctccaggtcgccgacctccggcaggtcgttgtagaggtcggcgagcagccacatcaggaaggtggagaagagctgcggcttgtcctggacggcgggcagttccaggacggagaccaggccgcgcccgtccgcggccgtgcggaggaactcgccggtgtcgaactccggctcgccgaagaactcggaggccccctgctgctcgaaggccgtcagcgcccgcaggatcactccggcggtcacggtggagagcccgccgatgcccttgagttcgggtttgccctggtcggagacgaggaaggcgacgaccgcgcgcagatccttgaggtcgaccagctccaggcccttggtgtcggcgtagtggaagatcaggccgagggactgctcctgcgtctggttgagctccagcaccttggacatcagcaccgggccgaagctggtgaccgtggaccggagcgggattccggggccgatgcctcccagcgagtagaacgcgcaggggtatccggtgggctcccacgactgggccacgtcgcgggcccgttcgtcgatcctgtcgcccgccgtaccgggcaccgagattcccgagatgtcgcccttgatgtccgcgaggaagacggggacaccgctcgccgacagctgctcggcgatgagctggagcgtcttggtcttgccggtaccggtggctccggcgaccagtccgtggcggttgagcatcgccagggggatgcggatctgacggtcgggcaggcagtcgccgtcccagaggagggccccgaggtcgagcgcgggtccggtgaaggcgtacccggcggcgatcaggccggccgggtccgccgggtccgtcttgtccgccggaaccgcggggtcggtgctctcgctcatgcgtgactccccaaatagcgctgttcgccacttttgcaccaccgtcacgaggctgcgcccgcacgcaccggcccggtaggctttccgtgtgatcttcaagcgcatcggaagcggacggccctaccccgaccacggcagggaaaccacccggcagtgggcggacgtcgcgccgcgcccggtccggctcgaccagctcgtgacgaccaagggccagctggacctcgaaacgctgctcgccgaggactccaccttctacggcgacctgttcgcgcacgtcgtgaagtggcggggcgacctctacctggaggacgggctgcaccgcgccgtgcgcgccgccctccagcagcgccaggtgctgcacgcgcgcgtcctcgaaatggactgacgacttcgcctgtattgcgcctttcgggtcaccattgacctatcagcagatcatttagtaggcatcgacaccgggtcgcactacgctgcgcccatgagcatgctcactccccccggcatgggcggaaagtaccgcgtcacgggagccgcctacccccgtatgagccgtaagcggagccgtcctcggatcgtcctcgccgtactcggctcgatccttgcgctggccctggtcggctacggggccctgcagctcatcgacgtgttccggggcgacagccccaagcggaacacggctgcgggtgccaaggactgcccgacgacgcctcccggtaccgccgccaagggcggcccggccgccgcctccaccgcctcggccgccgccaaaccggcggtcgtgctccccccgcccggggagatcacggtcaacgtctacaacgcgaccccgcgggcgggtctggccaaggccgtcggtgacgagctggccaaacgcggcttcgtgatcgggaacgtgggcaacgccccggccaccttcgacaagaaggtccccggcacggggatactgctgggctccccggcgaccgacaaggcggtcttcgccgtcctcggcacacagctcgccggcgccacccagcagaccgacacgcgcgagagcgcggacgtcgacctgatcctgggcgacgccttcaaggagctgagtacgaaggaggacgcggacagggcgctggccctcctggccaaccccgtgcccgcgcccaagaactgctgacgcgccggacgcgtccggcgttccggacgcttccgacgctccgggcgccccggacgctccgggcgcgcaccgcgcaccaccgcgcgggacgcgccggaccgccgtacggcgctactccgccgagccgtacatccggtcgcccgcgtcacccaggcccggcacgatgtagccgtgctcgttgagccgctcgtccaccgcggccgtcaccaccgtcaccggcgtgcccgccagctcgcgctccatgatctcgacgccctcgggcgcggccagcagcaccacggccgtgacgtcgtcggcgccgcgcttgatcagctcctggatcgccgcgaccagcgtgccgccggtggcgagcatcgggtcgacgacgtagacctggcggcccgagaggtcctccggcatgcgcgtcgcgtacgtggaggcctccagggtctcctcgttgcggaccatgcccaggaagcccacctcggcggtcggcagcagccgcaccatgccgtcgagcatgccgaggccggcccgcaggatcgggacgaccagcgggcgcgggtgcgagagcttcacgccggtggtcggggcgacgggggtctcgatgtcggcctgctccgtgcgcacgtcccgggtggcctcgtaggcgagcagggtcaccagctcgtcggcgagccgccggaaggtggcggagtcggtgcgcttgtcgcgcagggtggtgagtttgtgcgccaccaaggggtgatcgacgacctgcaaacgcacaacatcctccaaaactcagcctgcgacctgcaaaaacggtcgcacgacgcgacctgcacccaaaaggctacgcgctgacgcggccccttcgcgtccgaagcggcggccgcgcccgccgcttccctgcggatgcgacccgcgtggacgcccagcaggctggacggatgagcaacacaccggtgatcgcggccgtcgacggttcggaacacagcctgagggccctggagtgggcgcgggccgaggccgtccggcacgactgcgggctgctcgtcgcccatgtactgcccgaccacgcccagttgtacgccgggcgccgggcctccctgcacgacgcctccgaaccggaggacatccccgaccccgtacgcgagtgggtccgggccctgctcggcggcggacccggctcgggctcgggctccggagcaggccccggctcgggctcgggctccggagcaggccccggctcgggctcgggctccggcttcgaccccggcgccgggctgcccgccggggtcacgtacgaggctctggagggctcggtgcccgaggcgctgcgggtgatcggctcccggtcccggatgctggtgatgggctcccggggccgcggcggcttcgccagcctgctgctcggctccagcagccgggccgtggccagtacggccgcctgcccggtcgtggtggtcccgcacgcggagcgcggcgcccgccccgacgccgacgccgagctgtcggccgggcgggtggtggtcggactgcacgccgccgagacgcccgacgacgtactgaccttcgcgttcaccgaagccgccgtgcgggggaccaccgtccaggtggtctccgcgtacgccatcccgccctcgccgaacctggtgatcgacagccccttcgcggtgatcccgccggaggggctggccgacgagggggacggcgtaccggccgaacgggagatgctgcgctcccagacggagcggctggccccgctgcgcgagcgctttccggacgtccccgtcgagcaggccgcggtacccggggacccggccggccggctggtcatcgcctcccgggcggcggcgctgatcgtggtgggccgccaccacccgcgccgcaccgccatgtccctggcgatcggctcggtggcccatgccgtgctccaccacgcgcacggcccggtcgccgtggtcccgaccctcaaggacgacgcctgacctgcgacggggtggcatcaaacgctccgtccgggggaaggtgggtgcaaggggggacgaccgaccagccaggtggtggccgatgcccgacaggcagcccgacgacgaggtgccggagaccgcggcgcagcgccgcgcacgccgcgcgcagttcctgcgcgacctgatggaggcgcgcgagctgcgcgatcgcgtccagccccgccgcgcccgtgcggcccgtatgcgccagcagatgcgcatgcgcaccttccgctggtgatccggcgccggcaccggcccggcacgccgcgacacgtccgggccgcaccacccgccccacacccctccctacggccccgccgcccccgcgccgcaaccccgcacggcccctgccggtgcacggcgcggcacgacgcaagcgcggaagacctctcgcaaagccgctgtttctgccacgatgccgattgggcggggtacgggcggcgagcagcacagccgttctgccccatcctccggccggggggacctccaaccggcacgcctaagaccagtgggagagtcacggtgtatttcgccgcactgctcgcgcgcaccgaagacgggtgggaagcgagcgacatggaactcgacgacgtcgagtccctcagtgatctgatcgatctcgcccggtccgccgctgtcgacgacgacacggtggtcgccctcatcgagcaggaggacgcctggttcggcgtcgtccgcgtggacggcgaggaggacccgcggtacttcgtatcgaacgcctccgcggccgcccgcagctcctacggctcgatgctgaccaaagagctgctgggcagcgacgaggaggacgacgaactcgacgacctggacctggacggcaccgaggacggcgaggaggatgccgtcgccgcgttcacggacgaggacgccgacgaggacgaggtgggcgggaccggtgcggaaccggtaccggccggtccgctcggcgaccccgggctgctggacgatctcggggtgaccaacaaacaactgatgaccctcgacggggacgccctctcggagatcgccgactccctcggcgccaccgaggtcctggaggccgtccgctagtgctccccgcgaacacccccgatcccgtacgggacccgtggcgggactccatgcgcctggcgctccaggaggccgcccgggcggtgccggccggcgatgtgccggtcggcgccgtcgtgctgggcccggacgggcggatcctcgccaccgggtacaacgaacgcgaggcggccggtgaccccaccgcgcacgccgaggtggtggcactgcgccgggcggccgccgagctcggggaatggcgccttccggggtgcaccctcgtggtgaccctggagccgtgcgtcatgtgcgcgggcgcgctcgtgcagtcgcgcgtcgcccgggtcgtctacggcgcggacgacgagaaggccggtgcggccgggtcgctgtgggacctcgtacgggaccgcaggctcaaccaccgtcccgaggtgatccgcggtgtcctggcggacgagtgcgcgcggcaactgacggacttcttccgtgacctctgagccgacggatcggtccggggtcccgcacgcgtccggtccagggtccggaaaaggcctgcgtacggccgtcgcgacgcccccggacccatcgatttcagcggatggggttccttaggctaggatccatctcggtagtgtgtccgagtggccgaaggagctcgcctcgaaagcgagtatggggcaacccatcgggggttcaaatccctccactaccgcttcgatcgagagccccgccccgtaagggtcggggctctcggcgtattccgatcgcctctctggcggacacccgcgtgaccgcccgccccctcggccgttgtcacggcatgaccaagacccagcgcatgctcgccgccctcgccctcgcgggggccgccgcgggcctcgccgcacccgccgcctcggccgccccggtctcccccctcaccctcccggacctgccggcggccgcgccggggatgccggccggggcccagcccacgtccgtccaggagatcgggtcgcagctgagtgccggcgcgaaccagctcaacgcgctgatggagctgccgaaccagctggcccccgtcatcgcgcccgtacagcccctcacggacctggccggcggcctggagtagccaaccggttcccggtccgcctccgcacgcctctcgtgcacctctcgtgcgcctgcgagcgccccgcgcacgccccgcaggaaccggcaggaaccggcaggcccgccagcagcccggcagaccgccggaccacgtgaagaaggtcccggccggagccgggaccttcgacgggtgggacgggggaagtggcatcggggggacgaaccacttcccccgacgagggcggacctgccggtccgggccgcgttcagggggaagctcgcggctcggaccccgcagtgaggccctgcccctcacccaccggtttcctgccagaaccggtgggctcccacccatcctgtgcccgcctcgaccgcccgctccacggcaaagggcccggagtaccgggcccttggtccttaaaggacaggtgagtgtccaatcttgaccggttagactcacccgacttgctcggaccggttggggaggccgcccgcacgtggacaccaagaagctcatcacgggtgccctcaccgtgttcgccctcttcgtgatcatcacccagccgaagagagcggccgagatcgtggaaataggcttccaggggatatcggatgccgcctccggcatcggcgagttcatgaccgaactggtgcgctgacccgtacgctgaagcggttcccggacttccggccccccactccgacgggtggggggctttttgtatacccaccactgggcatattgccctgctatgcccaacttgccctcaacacggcgatatacggtgcttgcgcacagtgcacatctcttgtgatgctatgaccgcttttgatggatgagagttgactgaaggggtggcgtgaccgtgccggccagtactgcgcctcaagtgccaccccagcaggacccccaggtgccgccccagccggaaccccagcgggaacaccgcccggagccccgcccggagccgcccgaggagcccccggtcgcgccgagacccccgagcaggggcgcggacacccgggccctcacccaggtcctgttcggccagctgaagggcctggagccgggcaccagcgagcacagccgggtgcgcggggccctcatcgaggccaacctcccgctcgtccggtacgcggccgcccgcttccgcagccgcaacgagccgatggaggacgtggtccaggtcggcaccatcggcctgatcaacgccatcgaccggttcgacccggaccgcggcgtccagttcccgaccttcgcgatgccgaccgtcgtgggcgagatcaagcggtacttccgcgacaacgtccgcaccgtccacgtgccgcgccgcctccacgagctgtgggtccaggtcaacgccgccaccgaggacctcacgaccctccacggccgcacgccggccacctccgagatcgccgagcggctgcgcatcaccgaggacgaggtgctgtcctgcatcgaggccgggcgcagctaccacgcgacctccctggaggccgcccaggagggcgacggcatgcccgggctgctggaccgcctcggctacgaggacccggagctggccggagtcgagcaccgcgacctcgtccgccacctcctcgtacagctgcccgaacgtgagcaaaggatcctgctcctgcggtactacaacaatctgacgcagtcacagatcagcgtggagctcggcgtctcccagatgcacgtctcccgactcctcgcccggagcttcgcccgactgagatccgcaaacaggatcgaggcgtaaccggaacgagcgtagatcattcgcatgtttcccgacagatcggactgatcgccctccaggcctgtctgtcgctggagatatatgtcgacatggcgctacagcgcgttgccgacatgtgacattctgcgtgaaccgcgtttgccgcagccccgcctccggtattcaggtggaggctgcgttcctccgacgggcgcgcagtacgcgaccgtccgcgacctcaagggggtggcatgtccgtagaccagggcagctccaaggtgctcacgctcgtcaagagcgcgcctgcgcccacagcacctgcagcgtccgaccgctcggaagccatcgacacccggaccctctcccgctccctcttcctgcggctcgcagccctggatgcggacagccccgaacgggcgtacgtacgcgacaccctgatcgagctgaacctgcctctcgtgcgctacgcggccgcccgattccgcagccgcaacgagccgatggaggacatcgtccaggtcggcaccatcggcctgatcaaggcgatcgaccgcttcgactgcgaacgcggggtcgaattcccgacgttcgcgatgccgaccgtcgtgggcgagatcaaacgattctttcgggacacctcctggtccgtccgcgtcccgcgccggctccaggaactgcgcctggcgctgaccaaggccagcgacgaactggcccagaagctggaccgctcgccgaccgtgccggagctcgccgccgtgctcggggtctcggaggaggacgtcgtcgacggcctcgccgtcggcaacgcctacacggcctcctcgctcgactcgccctcccccgaggacgagggcggcgagggctccctcgcggaccgcctcggctacgaggacaccgcgctggagggggtcgagtaccgcgagtccctgaagccgctgctcgccaaactcccgccccgggaacggcagatcatcatgctgcgcttcttcgcgaacatgacgcagtcgcagatcggcgaggaggtcggcatctcccagatgcacgtctcccggctgctgacccgcaccctcgcgcaactgcgcgtaggcctcatcggggagtgatccggcgcctcgcgcttcccaattgacgatccgtcaggaaaactggcgcgatgcgaaagggatcgcgagccaccgccgccaccctgctcgccctgtgctgcacggccgccgccggcctcaccggctgcggcggcccggcgcgggacggctatctcgccgtgggcgccgcggccccgggccccgaacggggtgcgggggagaacgtggccccccggggccaggtggagttccagcagctcggcggcccggacgcggcgggcggatcctcggcgtccgcccgtacgtcgaccgccccctcgggatccgggaccccgggcggccccgccccgggcggagccacgacccccgccgccggcggctccgcaggcccgcccggcacccccgcggacccgggccgcaccccaccgtcacccggcacacccgacaggcccggcacgccgacgaagcccaccggcccgtccgcgccgggcaccccgggcacaccgagcaccccgggcacaccgacgagcccgcccggcaggccgggcacgactccgccggccccgcccgcgtccactccggcccggctgacgctgtccgcgccgctccggtcggccgcggccgaccgctggtgcgagcgggtcaccgtgaccttcaccaacaccgggaccaccgccgcccgttcgggcacggtcagcttcgcgacgcacatcatcggcgccctcggcatcgactgggccacgatcgcgacgagccagcccctgccggcgccactggcgggcggggcctcgaagacgcagacctacacggtgtgcgtggagtcctggcgggtgccgctgggcatgcacgtggacacccggaaggtcaccgcgacctggagctgagcggccggtgcggccgtcagcgcatgaccagccagaccgccgcgccgatcacgagcaccagggcgaggaccagccccaccttcgcggccgggttcgaggacccggaccgctgctgctccgcgcgacgctgctgacgggctcccggacccgcctgccgggccggtgcggcctcctcgacgaaggccttgaacatctgcgtgctgcccgcggggtcatagttgccctcggggacctgtgagttgcggttgtcagccatggagcaggaccctagccggttttccgattcctttaccgccccaccccccggattcatttgcctgtagcaaccatgcgcttctatggttgcctcaagcaacgagatggggaacccggtgaccgtgcagaccgctccaaccctgcagagcactccgaacctgcagagcgcaccgaccctgcagagcgcatcgagcccgcgcccgcagaacgcaccggccgtccggacggctccgcccgcgcaggccgctccgtacgcggagctggcccgccagctcaccggaatcggtgcggtcaagcgcgagctcgcccgcagcctgcccccggactgcccgcccggcgccgccgccgtcctcaccctgctcgaccggcacggggagatgcggctgagccggctgaccgagttcatgggggtcgacatctcggtgaccagccggcacgtcacccacatcgccgaccgcggctggatcgagcgcgagaccgacccgggcgacggtcgctgccggatcctgcggctcaccccggccgggcgggcgctcctcgccgagctcggcgcccgccacacggcctcgctggagagagccctccgcgactggtccccccaggacatcgacgtactgaacaccctgctggcccgactccgatcgagcttctgaacaaaggaaagacatggcccagtcggagacgacgaccgaccatccgcccacgtccgggggcacgtccccggccacttccgtgaccatgacccacccgcagatcatgaaggcgctgtccgggctgatgctcggcatgttcgtggcgatcctgtcgtccacgatcgtctccaacgccctcccccagatcatcagcgacctcggcggcacccagtcctcgtacacctgggtggtcaccgccgccctgctgtcgatgacggccgccaccccgctgtggggcaagctgtccgacctcttcagcaagaagctgctggtccagatatccctcgtgatctacgtcctcggctccgtggtcgcaggcctgtcccagaacaccggcacgctgatcgcctgccgcgtggtccagggcatcggcgtcggtggcctctccgccctggcgcagatcgtgatggccgcgatgatctccccgcgcgagcgcggccggtacagcggctacctgggcgcggtgttcgccgtcgccaccgtcggcggcccgctgctgggcggtgtcatcaccgacaccgagtggctgggctggcgctggtgcttctacgtcggcgtgccgttcgcggtcatcgcgctgatcgtgctccagcgcaccctgcacctcccggtcgtgcgccgcgacgtcaaggtcgactggctgggcgccttcctgatcagcggagccgtctcgcttctgctgatctgggtcacgcaggccggcgactcctacgcgtgggtctcctggcagacctgggcgatgaccggcggggcgctgctgctcggcctgctcttcgtcctcgtcgagtcccgcgcgagcgacccgatcatcccgctgcggctgttccgcaacaagaccatcaccctggcctcggcggcctccctgttcgtcggcatcgcgatgttctcgggaacggtgtttttcagccagttcttccagttggcccgcggtgagtcccccacgatgtccggaatcctcacgattccgatgatcgccggcctcttcgtctcgtccacggtttccggtcaggtgatcaccaagaccggtcggtggaaggcctggctcgtctccggcggcgtcctgctgacggccggtctgggtctgctgggcacactgcgccacgacaccccgtactggcacatcgcgatctacatggcggtgaccggcctcggtctcggcatgatgatgcagaacctggtcctcgccacccagaaccaggtggctcccgaggacctgggcgcggccagctcggtcgtcaccttcttccgctccctcggcggcgccatgggcgtctccgcgctgggcgccgtcatggccaaccgggtcacgcactacgtccaggacggcctcgccgcgctcggcccgaaggccgcggccctcggccacggcggcaccggcgggggcggcatccccgacctcgacaagctgcccgcgccgatccgcgaggtcatcgagaccgcgtacgggcacggcgtcggcgacgtcttcctctacgccgccccgttcgcgctgctcggactggtcctggtggtgttcatcaaggaggtcgccctgaagtcgaagccggcggcgcacgccccggcggcggcatcggacgaggcggcggcccccaccgagcccgccgtcaaggcctaggcggtcagggccgacgcctaggcggtcagggccgacgcctaggccgtccgggctgacgccttggcctcgatgcccgcgatgaggacgtcgagagccaggcagaaatcgccctcgggcgcccgccggaccgtactcccacagccgtgcaggaactgggagacggccaggtgggcgcccgtacgtgcaccatcggcgagacccgtggcatccagcagccgctggagcgcggcgtcgaaggcccgcgcgtgcgggccgatgttcgggaacgcggcggtgagcggggccacccagggatggtcggccagcacccgccggtagccgcgggccagcgcctgcagccgggccggccagcccgccccgccgccctccaccggcggcggccgcagctcgccgagcgcgctgtcgagggcgagttcgagcaggtcctgcttggtctccacgtaccagtacagggacatcgcggtgaccccgagcccggcggccagccgtcgcatcgagaaccgggccagtccgtcggcgtcgagcagccgcacggtggcggcggtgatccgctcccggtccagcccggagggtgcttcgctgcggcgtctggcgggtgcggcgggccttgcggccagccacacgctgatgcgggtctcaccgggatcggccgcggtcgccatgcaggcaccctcctcacgacaggtggatcagcccggaatgcccggtccgccccctcgatgctagagccagcggggcggatcgggccggatcggaccggatcaggctgaatcaggtcggatcgggttggatcaggtcggatcaggtcgccggggtcgtcaggtcgtagaaggtggccccgccgaccgtggtcggcttgaaggtggccttgatccaggtctcgatgtccgtgccggtgccaccgcccggaccgcccgggccggccggaccgccgccgcgggtgttcccctcaccggcgccgtccgcaccggccatggtgttctggccgatgaaccagtggatcttcccgtccctgacgtacttctggaactgctccagcgtcggtgaggggtcactgccgttgaagccgccgatcgccatgaccggtgcgccggaggccagctgatagctcgccgcgttctgggagccgatggcggccgccgcccatgtgtaggcgtcggcgtcggtggtgagggccttcttggcctccgcgctcacccgggcgccgttcagcaggccgccggggccgcccgccccgccaccgccaccgaaccgctcgccgccacgtccgccctggccgcccgtaccgccctggcccggcggcatcccgccctgcggcatcccgccctgcggcatcccgccctgcggcccggcgcccggcattccgccgttcggcacgccgccccggccgccctggccctggccctggccgcccgggaacatctcgcctgcgccgccagggccgccgaaagccccggggccgcccctcatcccgccggggccgccccggccgcccgccaccgccggaccggcggtcacgatggagccggtgtgcgcggtgctcacggtggtcaggcagtacgcgaacggcccggccagtgccgccgccacgcccagcgcggccgttgcctgcagcgcccggcgcccggcccgagcggcgaacggcagcgcggccgcggcgagcagcccgcccaccaggaccgcccagcgcagccacggcagatagccggtggcccggccgagcagcacgtacgaccagaccgccgtcagggcgagcgtgccggacagggtgatcgcggcgacccggccgccccgctcctcccacagcacggcggcacccatgccgatcagcgcggccacgaacggcgccagtgccacggtgtagtactcgtggaagatgccctgcatgtagctgaagacgaccgcggtgatcagcagcgagccgccccacgccaggaaggccgcccgggccatgccctccagcgtgtcggtggtccggcgggcccgccaggtgatcaccagacccgccaccagcagcaccagggccgccggcagcagccaggcgatctgtccgccgatgttgcccgagaagagccggtcgatgcccgtctccccccagccgccgccacctccgcctccggcgccgccgcggccgccgccccccacgctgccggtctcgttgccgttgatccggccgagtccgttgtagccgagggtcagctccaggaaggagttgttctgcgagccgccgatgtacgggcgcgaggaggccggccacagttcgacgacggcgacccaccagccgccggccaccaccatcgcgagccccgccagcagcagctgcccgagccgcttgcgcagccgggtgggcgcgcagacggcgtacagcagggccagcggcggcaggatgacgaaggcctgcagggtcttggtgaggaaggcaaaaccgaccgccaccccggcccagaccagccacttcgtacgggcgccgtcgagggcgcgcagtacgcagtacacggtgacggtcagcagcagggtcagcagcgcgtcggggttgttgaagcggaacatcagcgcggcgacgggcgtcagcgcgaaggcggcgccgctcagcagcccggccccgggaccgaactggcggcgtacggcggcgtacagcaccccggtggtcgcgacgcccatcagggcctgcggtacgaggatctgccaggcgccgagcccgaagagccggacggacagcatcatcggccacagggccgccgggggcttgtccacggtgatggagttgccggcgtcggaggagccgaagaagaaggccttccagctctcgctgcccgcctgcacggcggcggagtagaaggagttggcgtagccggaggagcccaggtcccacaggagcagggcggcggtggcgatcagcagcccggccagggaggggagttcccagcggggacggtcgaccgcgaggcggccggtacctgcgcgggcctcgggaaccgggaagagcgagggtgctgccgtggtcatcggatgtcgtccttcacgttcacgggagtgtcgcgccgctcggggaagacccaggcgcggaagagcaggaagcgcagcacggtggcggcgaggttggcggtgatcagcacggccagttccgtgctgtgcgcgggatcggcggtggccgccccgagcgcggcgagggagccgctggtgagggccagcccgatgccgaacaccacgaggccctgggcctggtggcgcacggcccggtcccggccgcgcaccccgaaggtgagccgtcggttggcggcggtgttggcgatcgcggagagcagcagcgcggccccgttggcgaactgcgggccggtcccggcacggaaggcggagtacaggagcaggtagaacacggtggacagcgctccgacggcgcagaagccgagcagctggcgggccagtccgccctccactccgggcagtgcggcacggtcgcgcggatcgtcgccgaaggggcgggcgagccggtccagcgggagcgcgccgaccgccagtgcccggcccacgcgccagacacccctgaggtcctcggtggcggtccggacgatgtggacggtggagtcggggtcgtcgacccagtccaccggaacctcgtggatccgcagcccggcccgttcggcgaggacgagcagttcggtgtcgaagaaccagcccgtgtcctccaccagcggcagcagccgctcggcgacctcgcgccggatcgccttgaatccgcactgcgcgtcgctgaagcgggcggcgagggaggaacgcaggagaaggttgtaggcgcgcgagatgaactcccgcttcgcgccccgcaccacccgtgaggaccgggccaggcgggtgccgatggcgaggtcggaatgaccggagatcagcggtgcgaccagcggcagcagggcgttgaggtcggtggagaggtccacgtccatataggcgaggacgggggcgtcggaaccggaccacaccgtgcgcagggccctgccccggcccttctcctccagccgggtgctgcgtacgccgtccagtgcggcggcgagcccccgtgccacctcgggggtgcggtcggtgctcgcgttgtcggcgaccgtgatccggaaggggtaggggaaggtccgggtcaggtgctcgtgcagtctgcggacgcacgggccgaggtccttctcctcgttgaagaccgggatcaccacgtcgaggacgggctcgccgggcacgggcgcgaggggcgcccgtgccgggagggccccgggagaggtgtcggttcgcatggtccgacactcgcggggcgccctgtcaccgctgtgtgctgagcctgtgccctgcctgtgagtccggcagatccggaaggtccggcaggtccggccgatgcggcaggtccggccgatgcggtcccgcgtgcggcagcaggacctcgaagcaggtccgtccgggctcgctccgtacgccgacccgcccgccgtgcgccgtgaccacggcctggacgatggccagcccgagcccggtggagcccgccgcacgggagcgggaggcgtcaccgcgtgcgaagcgctcgaagacgcgggggaggaggtcgggcgcgattccgggcccgtcgtcctcgatccgcagccggacggcggatgtttcacgtgaaacgtgcgcggtgacggtggtccccggcggggtgtgcgtacgggcgttggcgagcaggttcaccaggacctgctggatcctggccgggtcggcccggatcggggccggctcctcgggcaggctcaggcgccagtggtgctcgggaccggcggcccgggcgtcgctgacggcgtcgacgacgagcggggccagatcggtgtcggcgtcgccggtggagagcgggcggcccgcgtcgagccgggccagcagcagcaggtcctcgaccaggccggtcatccgggtggcctcggactcgatccggcccagggcgtgccgggtgtcgggtccgggctcctcccgtccccggcgcgtcagttcggcgtacccgcggatggacgcgagcggggtgcgcagctcgtggctggcgtcggcgacgaactggcggacctgcatctcgctctgctggcgggcggtgagggcggaggagacatggcccagcatccggttgagggccgcgccgacctggcccacctcggtgcgggggtcggcctcggtgtccggcacccgctcgtgcagggcgggttcgcccgtgtggagggggagctcggagacccgggtggcggtggcggcgacccggcgcagggggcgcagggcgaccccgacgagggcctgaccggcgagggaggccgcgatcagcccggccagggtgacgcagagctccacgccgaccagggtgcgcacggtggagtcgacaccgctcaggggaaagccgagggcgagggtgccgtcgggcgcgatcagcacccggtagctgccgagcccggggagctccgcgtccaccggctgcggcctgccctccgcgacgttccgggcggcccgggcgagggccgtgccctgggcctcggtcagcggcggcggctgttcggccgaccagccctcgacgcgcacgttgcgggccgtcccgacgacggtaccggcgggatcgaggcggatcccggcggcgtccagcgggctgccgggagccatgacgaagccggcgctgttctcccgggccggcttcccgccgggcgcccggacggccatccgcacggaggttttcagctgtccgtcgagctcggtgacgaggtacgagcgcagggcgaaggtggtgacggtcccgatggccgcgcccaccaccgcgatcagtaccaccgccgagacgacgagccgggtgcgcagcgaccagggacggcgtccgcgcggccgccgtttcgtgcggagggtcactactcggccggcttgatcaggtaaccggcgccgcgccgggtgtggatcatcggcggcataccgataccgctctccagcttcctgcgcaggtaggagatgtagagctcgaccacgttggcctggccgccgaagtcgtaggaccacacgcggtccaggatctgggccttgctcagcacgcgccgcgggttgcgcatcaggtagcgcaacagctcgaactcggtggcggtcaggtggatctcgcggctgccccgcaccacctcgtggctgtcctcctccagccgcaggtcgccgacggccagtaccgaaccgccgcgagcggcctgcgccgcgccggagcgccggaccaggccgcgcagccgggccacgacctcctccaggctgaacggcttggtgacgtagtcgtcgccgcctgctgtgaggcccgcgatccggtcctccagcgagtccttggcggtcaggaacagcacggggacctgggggatctcccggcgcagccgcccgaggacggccaggccgtccatgtcgggaagcatgatgtcgaggacgaccacgtcgggccggaactcccgggccgcccgcaccgcgcccgccccgtcgccggcgctgcggacctcgcagccctcgtagcgcagggccatggacagaagctcggagagcgaggcctcgtcgtcgacgacgagtacccggcagggtccgccgtcgggccgtaccagggccgtcgggtggttggtggacgtggacgcatgggaggtggtcgtcgcagtcataccggacacgctgtccgctgcctctgagagcgttcttgtgcctacctgtgaatttcctgagaaagggaggcccggaagaaggagacggaagggagggcggagggagggagggcgggcggagggaggggccgagtaaggggcgggcagccgtccggacggccccggtccggtccgatggtcagccgtcgagacggaacagccgggcgccgttgtcgtggcagaccgcgcgcagccagtcgtcgccaaggccgagccgttcgagggcggcgagttggtgctcgtaggggtaggggatgttcgggaagtcggtgccgaggaggatccggtctccgaggtcggcgagccgtccgaggtcgccgggcgggaagccgtacatctcctcggagaagtcggtgaaggccatggtggtgtccaggcggacctcggcgtaccggtcggcgaggtcgaggaagtcggcgtactcgggcatgcccatgtgggcgacgaccagcggcagcctcgggtggcgggccagcagccgggctatcggttcgggtccggtgtgcttgccggggacggggccggaggcgcagtggatcacgatggggaggccggcctcggcgaggagcccccagacggggtcgagccgctcgtcgttcgggtcgtagccgccgacctggaggtgcgatttgaagatccgggctccggactccacggcctggcggacgtacccgctcacgccctcctccgggaagaacgtcgcggtgtgcaggcagtcgggggtacgggcggcgaaatcggcggaccaggcgttgagccaggcggccatggccggcttgtgcgggtagagcatggcggtgaaggcccggacgccgaactcccgcaggagcgcgacgcgctgctcctcctcgtgccggtaggtgatgggccactcgacgccggtcagcgggccgaccgcgtcgaagtagtcccacaccttgtccaggacccgctcgggcatgaagtgggtgtggacgtcgaccagtccgggcagcccgagccgctcccggaaggcgcggaccgcctcagccgttgcggacaaagccgtggctccgctcgacggtgccgacgtgcagggtgtagctctcgtaccagtcggcgcggccctgcctcatggccgcctggtgctccatgtcctcccgccaggcggtgagggactcgtggtcgcggaagtaggccacggtgatgccgaggcccccgggggtacgcgccgactcgtacccgaggtaccccggattcccggggaccagctcctgcatccgcgcgagggtctcggggtatccgctgtcgtcggcggcgcggatgttgctgaagacggccatgacgtaaggaggttcgaaggcctgcaccggctgaatgatcatgcccaacaccttcgacgcagcgcccccgacatgtccacctgaatcacccctgaaagcccaaagggatccaagttttgaccttggccaccgcactccgcgccgggtccggcaccggggtccagtggtgtcagaacagcccgtcctgctcggcggaagccgcagaggcggccgggagctgtgccgtcgggaccgaggtcacgtcctcgtcccccggggcggtgagctcccagcccgccagcagccgggtgtccaccaccagtccgtccgcgaggtgcagatcgggcccggcggcgcccacgagccggcccacgacggaccctccggacagcatctcggtgagcacgcgacccggcccgggcaggcccggcagtgcgtccagcccgaacaccgcggcgtggtcggccacttcgcactccacacgctccagcgactccggccacccggccagcgccgcggcccgtgcgtgcagctcggcgacctcccgcgcccgatcggacgcggccggcagatgggcccgtacggcgcgcttgcgggcgtacgggatccggtcgggcaccccgagcgccgcccgcagcagctcctcggtgcgccgcgtcgccatcagcggcccacgcccgagccaggcccacgtcacggccccctgctccagcagccgggccgagccgcgctcctcggcggtgatcccgaccttgaccacgccgggcccgaaccaggccaggtagacccggtaggtgcgcggatcggcggcgttggtgtcggccgccacggagaacgaccggtcgaggcgggcgcattcggggcactgcgcgttcccggtgcggcccggcacggtgtccgcggtggggcagggcgtccgcttgccggcccgccacacgcccaggcagtgccgctgcccgcgtgcggcgaaggcgatccgctgcccgtacgcgagctcgctcatccgcccgccgcgcccctgtccgtaccacccgatggcggggcggccgtcctgccaccggatcccggtacaccaccacgtcacagcgggagtggccgctcgaagaaggtgtccaggacgacggtggcgtgcgtcccgctgacaccgtcgatggcgtagaggcggcgcaggacgtcctgcagctgctcggtcgaggccgtacgcaccttgaccagcacggacgcgctgcccgcgatgatgtgcgcctcctggatctcggggatggcggcgaagtcggcgccggcctcgcccatccaggcgttggagtcgaccatcacgtaggccaggactccgctgccgacggccgccgggtcgacgtccacggtggtccgccggatcaccccgcgctcgcggagtttgcgtacacgctcgtgggtggccccagccgagagccccacggccgtgccgagggcggcgtacgactggccggcgtcctgctgcaggcgcaggacgagcgcacggtcgatgtcgtccacgcaatcttcctctcatgggcctgtcgacccttgcgaagacggtacctgatcctgcaatctcaccatcagaccgaacaaaattcggcaaagctcttccagggggaatcatgtctgccatagccgacctcaccttgtacgagattctggacgaacgcttccggaccggccgctgcgccaacggcgacgcccggctggagcggctccacgacgactgccgctgggccgagggcccgctctacctgcccgcctggcggcaactggtgtggagcgacatccccaacgaccggatgctgcgctgggacgaggcgaccggcgcggtctccgtcttccgctccccggccggccactccaacggcaacaccctggaccgcgagggccgcctgatcacctgtgagcagggcaaccggcgcgtcacccgcaccgaaccgaacggcagcctcaccgtcatcgccgaccgcttcgacggcaaacggctcaacagtccgaacgacgcggtcgtccgctcggacggctccatctggttctccgacccggacttcgggatcaccagcgactacgaggggcaccgcgcgcccagcgagatcggctcctgcaacctctaccgggtcgacccctcgaccggcgaggtccggatggtcgccgacggcttcctcggccccaacggcctggtcttctcccctgacgagagcgagctgtacgccgccgacacccgggccggccacatccgcaccttcaaggtcaccggccacggcaccctcaccgacggccgcttcttcaccgactgccccggggtcgacaacatccgcttcgacgacgagggccggctgtgggcggcggcgatggagaacggagtccggtgctacgccgcggacggcaccctgatcggccgcctccgcgtccccgaacccgtctcgaacatcgccttcggcggcgccaagaacaaccgcctcttcatcaccgccaccacctccctctactccctggtgatgtcggtgaccggcctgccccgagtcctctgagggccgggccgcctaccgggcgacgaactgggtcaggatcgcctgcacctcgtagatgtcgacgcccttggtgaaggtcttctcgatcggcgccgggctgccggatatccagatcttgagttcggcgtcgagatcgaagtgcccggcggtctcgacggagaagtgcgtgatgctccggtacgggatggagtggtactccaccttcttccccgtgagcccctgcttgtcgacgagcaccagccgccggtcggtgaacaggatcgtgtcccggatcagcaggtacgcggcatgcacctgctccccctgccccagcagccgcgcgtagtcccgctgcgccgacacggggtcgacggtgtgcgcgttcccgaacagtcccatgagtgcccccgttttccggcttcgaacgatcttcagaaaccgtacccaggcagacccctcgcccgcgtcccccgccagagccatccgacccctgacatcctccgggggaccccctccccatcaaggaggagacggagaaccgtcaggacatacgacagaggcccccaggatttctcctgggggcctctgtcttgctgtgcactcggcaggattcgaacctgcaaccttctgatccgtagtcagatgctctatccgttaagctacgagtgcttgggcttcccggggttttgcgccccgttggccttgcgagaacaacaatacatggacctcgccgggacgcgaaatccattacccaaacccctgctgacctgcggaaatgagccggatggagatcgtccggatgggttcgcgcggagggcggagcgggccggatcgtcccggaaagcatcgaagccccggtccgtcaggaccggggcttcgatgaggtgcggaggcggagggatttgaaccctcgatgggtggtaagacccaaaccgcattagcagtgcggcgccatagaccggactaggcgacgcctccagcacaccctcgcgtacgaaggtgcgtgcagatgatgacacaggcgcagggcccctcaccaatccgctcccacggtactaggcgggacgggcggagggcaaagccttaaagcaggccgcgacacgcaacgtcggcgcgcccgcgtcgttgggcagacgtacgacgtacggacgacctggagtgccccatgctgcgtctcgccgccttcgccgtcacctccgccctggccgcctcggtggccggaccgctgcctccgctcccgctgggccggctgctggcgccgcccgaccgcctcaccatcaccatggccgacaccggcaaccgccggctggaccgggagtaccggctcgaatgcggccccgtcggcggcgaccacccggaggcggagggcgcctgtgcccggctggaccagttcgccagggaggggaaggaccccttcgcccccgtctccaagcggcagatctgcaccatgcagcacgggggccccgccaccgcccggatcaccggaacatggaacggccacaaggtggacgccacgttccggcggaccgacggatgcgaaatccgccgctgggacgagttggaacctctgcttccgagtgggcgtgcctgacctgggaggatgcgcgggatgggcggtatacgccacacatcggccaccccatcgcgggcctgtggccttagactcctcccgtgacttgccggtagttgtggtcagggaggaagctcgtcgtgagcagcaggccatcccgaggcgctgctcgcctcgcagcaatactcgatgcccttccggacgcgctgttgctcgtcaacgccaacggcacggtcgtcaacgcgaattcgatcgcgctcgaaatcatggagagccccggtaccgggctcgtgggccggggcgtgctcgacctcctgcccgagttcgactccaagctgatccccggctccatgcgccggcccggcgaggacgacggcggccgcgccaaacccaagaggatgatcgcgcgccgtaccgacggctccgagttccccgtcgagctcaccagcgcccatctcgacggacgcgacgcctaccgcgagccgcaaccctcgtacacgggtgacgaactgctgatgctcgtggtccgcgacctctcgcagaccgtggacaccgaggccgagctggcccgctcgcagcggcagaccgagatgatcctgcgcgccgccgccgagggcgtcgtgggcaccgacaccgacggacgggtggtgctggtcaacccggccgcggcccagatcctcggctatcgcgccaccgacctcggcaaccgcgaactgcacggcctcgtccagcactcccgcgccgacggctcccccttccccttcgaggagtcccccctcgccgacaccctccgcagcggacgcaagcaccgcgtccgcgggcaggtgctgtggaacaaggcaggacagccggtcgccgtcgacctcaccacctcgcccgtgcgggacggcgagcagctcgtcggcgccgtcatgaccttcaccgaccggcggccctacgacgccctcgccgcgcggcacgcgcagctgatggcggtcctcggcgagtccctgcgggggccgctggacgagctgcgcgctgagctggcgacgctggccgccgacgacgccggacagctgtggcccgaggccaaccagctgctgcaccacctggccgccgggtactcacggatgaccacgctggtggacaacgtcctcggctaccagcgtctggacgccggcagggaccggctggcgaagaagaaggtcctgatcaacaccgtcgtcacggcgggcgtcgacggggccgtcgagctgatcggcccaggccgcgcgcagttcgccgtgcacgcaccgaccatcgaggccgaggtcgacgcggaccggatctctaccgcgctcgcccacctggtcgcggacgtggccggggtggacgcgaccggcaagacccgccagggcagcggctacagcgactcgacgatcgtggtggccgccgcgcagcgcggcgatgtcgtacggatcgaggtacgcgggccgtacgagggcgggaacccggtccacgagccgatcgtgcgcgggatcgtggccgcgcacggcggcgtgctgcagacggtcgaggtaccgggtgcccccggcggggcgtacgtactggaactcccgctcggctcgggagcggggacggtgaccctgccggagccggcggaggagccccccgcggatcccgccacgcagggcgctgggacggccgcgggcgcggctcccggcaaggtatccggcggccggcggggccggcgcggggtggacgccttcctggacgacgagaacaccggccccgaagcggcgcaggccgcacaggccgcgcagggtggcggcgcgctggcgctgccttccggtcggcggcgggcgggtgaggccggcgacgcccccgacgcgggccccgagctcgcgcagtctccggtgaacccggcgggactcggcaccgggcgcaggcgcggccgggccggtgacgtcagcggtgaggccgaaggcaccggcgggcacgacggccccgggcggcccgtgcccccgcggggcaccgccatgcccgcgctcccgcccgtacccgcggtgcccccggttccggtgacggagcatcccgccgggcggcgccgggcgctgggtcaggccggtccggcgcagcccggcggccccgtccccgcgaccgggctcggcccggctcccgctcccgcgcggcccatcgctcccgagggcggcttcgcgctgcccgccggcccgacaccggctcccgccgcggccgactccgactccgacgctccggccgggcggcgtggccgccgggtgctgggcgcccccgccgccgaacccgaggctccggccactgccgccaccgcggccgcgcagcccgacgagtccgccgcgaacccgaccgggcggcgccgtgcgctggccggcggcgccccggcatggccggttccggcggcccgtaccgctcccgaggagggcgaggcctccggacaggcggcggtccccggtgcgcgtcggccccaggacatcccggtggagggccaggccgcgcagccgatcagtgtgcgcgcgctcggcaccctcggccagggcatctccgtcgacccgggtggctccggcccggcctccggctccggtgccacctccggttccggtgcggcttccggctccggccgccgtcgccggctcgccgagcccgccccgcagggccgggccttcgccatagaggcgcccgaggccggctccgacgagggccccgagccgctggacggcccgggcggcgccgtcgaggtggtcaaccggcccgcgccgccgcccgttgacgacgaactgcctccggagcccctggacaatccgcgccggctcctcgtgtggcccgcgcccgacgtgcagacgacgcaggcgctgagcgaccgcggctaccggccggtgatcgtgcactcccgcgaggaggtggacgcgcagatcgccgcgttccccgccgcgctgttcgtcgacccgctgaccgggccgatcacccgcacggccctgcagtccctgcgccaggccgcggtggccgcggaggtccccgtactggtcacggccgggctggggcacgccacgcgcgaggcggcgtacggagccgatccggccgtgctgctgaaggcgctggcgccgcgcgacagcgagcagcacccttcccgggtgctgctgatcgaggagcacgacgagatcgcgaccgcgctgacggccgcactggagcggcgcggcatgcaggtcgctcgggcgggcgccgacaccgacgccgtggaactggcgacgcggatgcgtcccaatctggtggtcatggacctcatgcaggtgcgccgtcggcgggccgggatcgtggactggctgcgcgcgaacgggcagctgaaccgcaccccactcgtcgtctacacgacgaccggcatcgaccagtccgaactgccgcggctcgcctccggcgagagcgtcctcttcctcgcggagcggtccaccacggcggatgtccagggccgcatcgtggacctgctcgccaagatcggcaccaactagtaatcctgggccgatggccatcatcaacacgagcgagcacaccgtccccgccgacaacggggaggtgaatctgctcatcgcacggcaggtggagcccggccacgaggagaccttcgaggcctgggcccacggcatcctggagacggccgcgggcttcccggaccacctcgggtacgggctcttccgcccggcggcggagggcgggccgtggttcctggtgcaccgcttccgcaatcaggccgcgttccagcgctggcaggactccccggagcgggcgcagtggttctccaactgcctgggccaccaccacacggagatagcccgccgggaactgcagggcatggagacctggttcgccaagccgggtacgacccggcccgcgccgccgcggtggaagatggtgatcagctcggggctggccatcttcccgatctcgctggtcggcaacgcggtgctcgggccgtacctcgtggatctgcatttcgtgctgcggacggccgccttcgccgtcgtgttcagcaccctgatgacctacgtggccatgcccgcggtcagcaggctgctgcggccatggctcacccggggttaggggctgtccgacccggatccgccggacgccccctgaccgcccggcgtcgtcagtcgagcttggtgacgtccagcgcgccgtccgcgtactgcctgcggatcaccttcttgtcgaacttgccgacgctggtcttcggcaccgcctcgatgaacgtccagcgctccggcagctgccacttggcgacggtctgggcgaggaactcgcgcagaaccgtgtagggcacgctcgcaccttccctgaggacgaccgtggccagcgggcgctccccccacttctcgtcggggacggcgacgaccgcggcctcggcgacctcggggtgcgccatcagcgcgttctccaggtccacgctggagatccactcgccgccggacttgatgacgtccttggcgcggtcggtgagggtgaggaagccgtcggcgctgatcacaccgacatcgccggtcttgagccagccgtcggcgctgaacttgtcctcggggcggatgggttcgccggagacaccgccgtagtaggagctcgcgatccagttgccgcgcacctccagctcgcccgccgactccccgtcccagggcaggaggtcgccgccgggaccgatcaggcgggcctcgacgcctgccgggaagcggccctgggtgatccggtagggccactcctcctcggcgctcaggcccgccggcgggtgcgccatcgtgcccagcggcgaggtctcggtcatgccccaggcgtggcagacgcggaccccgagcttgtcgtacgcctccatcagggagggcggacaggcagcgccgccgatggtgacctgcttcatcgaggtcaggtcgcgcgggttggcggtgacctccgccagcagcccctgccagatggtggggacggccgcggcgtgcgagggcttctcccgctcgatcatctcggcgagcggggcgggctgcaggaaccggtcgggcatcaacatgttgataccggtcatgaaggtggcgtgcggcagcccccaggcattcacgtggaactgcgggaccacgacgagggtggtgtccctgtcggtcagccccatcgactcggtcatgttgacctgcatggagtgcaggtagaccgagcggtgggagtagacgacgcccttggggtccccggtggtgccggaggtgtagcacatcgcggccgcctggcgctcgtccagctcgggccagtcgaagctgtcggagctgcccgcgaggagctcctcgtactcgtgcacgcgcacgttcaggccttcgagcacggagcgatcgccgatgccgctgaccaccacgtgctcgacggtcggcaggtgcggcagcagcggcgcgagcagcggcagcagggtgccgttgaccagcaccacccggtcggccgcgtggttgacgatgaagaccagctgctcaggggggagccgcaggttgagggtgtgcaggaccgcgcccatggagggtatcgcgaagtacgcctcgacgtgctcggcgttgttccacatgagggtggcgacccgctcgtcctgctgcacgccgagctcgtcgcgcagggcgccggcgagacgggtggcgcggttgccgatctcggcgaagctgcggcggtgcggctcggcctccccggtccaggtcgtgacctgggacttcccgtggatcgtcatcccgtggcggagtatgcgggtgacgaggagcggtacgtcctgcatggtgctgagcaaagcgtcctcccggtgagcgctgcggcgctgcggcggctacggatgctgccgattctgcgcacgtaccggtcggcatgtcactacccgggagtagaaaccggggcgtgtttcacgtgaaacatcccctgtcgtccccgtgtttcacgtgaaacaccctccgtctcaccgcaccggcatgagctccggatcctcacggagcttgcccagagcgcgggagaccgcgctcttgaccgtgccgaccgagactccgagcagttccgccgtctgcgcctcgctcaggtcctcgtagtagcgcaggacgaccatggcccgctggcggtcgggcagccgggtcacggcgcgccacatggcgtcgcgcagtgcctgtgcctcggcggggtcgcaggccggggccgcctcggtctccgggagctcctcgcacgcgaactcgtcgacctttcgcttgcgccactgggaggtacgggtgttgacgagggtccgccggacgtagccgtccagggcgcggtggtcctcgatccggtcccaggccacgtacgtcttcgcgagggccgtctggagcaggtcctccgcatcgcacgggttggcggtgagggagcgcgcggtgcgcatcaggaccgagccgcgggtccggacgtacgccgagaacgacgggtacggcgtcggattcgaggcgagcgtgcacacaggcgtggtcatgtctccacgctaggagcgcccgccctccgtgggatcggccgcaggtgccgatggtggatccacctcaggttgtaggaacagggccgcccccaccccctgaaggtggagggggcgggggcctccggtcccggatctcagccgtcggaaccgaggatcagaccggaggtcggcaccccggtaccggccgtgacgagtgcgcgcgccgcccccctgacctggttgacggacgtgccgcgcagctggcggacggcctcggcgatgccgttcatcccatggaggtacgcctctccgagctggcccccgtgggtgttgagcggcagcgcgtccgcggcgacgaaatccgcggcctcgcccggcacacagaagccgaactcctccagctgcatcagcacgaagggggtgaagtggtcgtagaggatgccgacgtcgatgtccgagggccgcagcccgctggtccgccacagctggcgggcgaccacgtccatctccggcagcccggtgaggtcgtcgcggtagaaggaggtcatgccctcctggcggcgcccggcgccctgtgcggccgcggtgatcacggcgggcgcgtgccgcaggtcccgtgcccgctcggtcgtggtgacgacgacggcctggccgccgtccgtctcctgacagcagtccagcagccgcagcggctccacgatccagcgcgaggcggcgtggtcggcgagggtgatgggtctgccgtggaagtacgcggcggggttgttcgcggcgtgccgccggtcggtgaccgcgacgtgcccgaatgcctcgggggtgaggttgtaggtgtgcaggtagcgctgtgcggtcatggccacccaggaggcgggggtcagcagcccccagggcagcgaccagccgagtgccgccccctccgccgagggctcccgctgctggaccccggacccgaagcggcgcccggagcgctcgttgaaggcgcggtagcagacgacgacctcggcgaccccggtcgcgacggcgagggcggcctgctggacggtggcgcaggccgcgccgccgccgtagtggatacgggagaagaaggacagctccccgatgcccgccgcctgggcgacggtgatctcgggactggtgtccatggtgaaggtgaccatgccgtcgacgtcggcgggagtgagtccggcgtcgtcgagggcggcgtgcacggcctcgacggcgagcttgagctcgctgcggccggagtccttggagaactcggtcgctccgatgccggcgatggcggcgcggccgccgagctcgtcgcgggtgcggacgctcatgccgggacctccgcggtgaccgttcccgacacgtggtggccgaggccgttggcgcctacgacgcggatctcgacggtggtcccggaaaccgcggtgacggtgcccgtgagggtcatcgtgtcgcccggatagttgggggcgccgaggcggatggccaccttgcgcaggacggcgcgcggcccgaggtggtcggtgatgtagcggccgaccaggccgttcgtggtcaggatgttcatgaagatgtccggggagcccttctcctgcgcgagcgccgcgtcatggtgcacgtcctggtagtcgcgggaggcgatcgcgcccgcgacgatcagcgtgcgggtgaccggtatctccagcggcggcagcgtgtcgccgaccttcatgcctgctctccctctcctgtcgaagcgcatgcggaggacgccgcgatcgaggcccccagctcggccagcagctcgctgccacagcccaggtaggcgtccagttggcgtccccacaggaagtgccggtggacgggatggtccaggtcggcgcccaggccgccgtgcaggtgctggcccgcgtgcacgacccgcttgcccgcctccgaggcccaccaggcggccgtcagcgcgtgctcatgggccggaaggccctgatcgatgcgccaggccgcctcgtacgtggtgacccggatcgcctcggtgtccatgtacgcgtcggccgcgcgcagcatgaccccctggttggtggagagcggcctgccgaactgctcacgggtggaggtgtactccaccgcgcgggccagggagcccgcgcagacgcccgcctggagcccggcgaaggccgtacgggcggcggcgagcgcgtcctcgtacgcaccgtccgcgccgaggcgttccccctcggccgcggtcagcgtcagccggcccgccgaccagggggcggtggtctccaccggggaggtccgcacgccgggcgcgtcggtccgtacgagccacagcgcccggtccgcgtccgggaccagtacgtgcgtggcgtcgcgcagccacggcacggccggggcggtcccggtgagccggccgccgtcggcggtgatccggccacgctccgggaaggccccggtggccacggcctcgcccgtgccgagggcgggcagcaggcgggcgcgctgctcgggactgccgtgcgcggccacggggaggatcccgtacacgcaggtggcggcgtacgggacctgagcggtggtacggccctgctcctccagcagcaggacgagcccgagcaggccgatctcctcgaccgcggcggccagtccggccgtggtgagggccttccacagctcggcgtcactgccggtacccgcttcggcgaggcgttcgtgggtggcgagatcggagaggatccgggcggcgagaccggccgcggcggcctgttcctcggtggggtggaagtccatcagccctcgctcccgcggaagacggggagttcgaggccgtcgtcgacgcgcagaaactccagctggacggggaggccgatgcgcaccttgtcgtagggcacccccgtgatgttgctgatcatccggaccccttcggcgagctcgacgagggcgaccgcgtagggcgggtcgaaggccgggaagggcgggtggtgcatgacgacgtagctgaagaccgtgccggcaccggaggcctcgacgctgtcccagtcggggctcccgcaggcgttgcagccgggtagccacgggaagcggagggccgtgcaggaggtgcagcgctggatcagcagcttgtgatcgcgcaccgcgtcccagaatccctggttgtcgcggttgaccaccgggcggggacgccgggcttcgggcttcttctcccgcctggccgcgggggcgtacttgaggatccggaagcggtgggtgccggcgagctccccgtccgcctggacgtccatgcgggtggtcacgaagtggccggtgcccagcttggtcgtcttgcgggcggacacggtctcgatgacggcgtcgaaggtgatcgcggcgccggggcgcagcgggcggtggtactcctgctcgcagtcggtggcgaccacggaggtgaagccggcgccgtcgaggagcgcgaggagctcgtcgtaggcggaggaccggtccgagtgaccggagagtccgcccatggtccaggcctggagcatggtgggcggcgcgacggcgtccggcccggtgtaggcggggttggcatcgcccatcgcctcgcaccagtggcggatcatcggctcgttgaccgcgtccttgccccggcccgcggtggcggccggccggccctcgaagaccgccagcagcgtgtggaaccgggccgcctcctcggcggcggcctctgccccggcctctgccccggccacatcccgggccccgttctcgtccacgcccacttccgcgcccgccgtcatcgcttcctccccttcatgccgagccgcatcatggcgacgatctcccgctggacctcgctgaccccgccgccgaacgtgttgatctgtgcggcccggttcatccgttcgagctcgccgcccgcgaaggccgcgggcccgcggatcagggcctcctcacccaccacctcctggcacatccggtacacctcgaccgtggactcggtcccgaggaacttcaccccgctggcgtcaccgggggccagggccccgctgccgacgtcctggacgaggcgccagttgaggaggcgtacggcggccagccgtgcgtgcgcctcggcgagccgggactgcacccaggggaggtcggcgggccggtcaccggtgaccgggtcgggggtgcgggcgtggccgagcgcgtgcgcgtagaagtcctcggcctgcatgccgatggcggcgagggcgacgcgctcgtggttgagctggttggtgatcaggccccagccgccgtgctcggggccgacgagatggccggcgggcacgcggacgccgccgtagtacgtggccgtggtggtgagcccgccgacggtgtcgatcggggtccaggagaaacccggggtgtcggtgggcaccaggatgatcgagatgcccttgtgcttgggggcctcggggtcggtgcggcaggcgagccagatccagtccgcgttctgggcgttggaagtgaagatcttctgcccgtcgatcagccagtcggacccgtcgcggaccgcccgcgtgcgcagggcggcgaggtcggtgccggcctcgggttcggagtaaccgatggcgaagacgatgtcgcccgcgaggatccgggggaggaagtagtccttctgctcctcggtcccgtacttcatcagggtggggccgacggtgttgagcgtgaccatggagacgggggctccggcccggtaggcctcgtcgaagaagacgaactgctcggcggcgccgcggtcctgaccgccgtactcgacgggccagccgaggccgagcagcccgtcggcgcctatgcggcgcaggagctcgcgctggccggccggatcatcgggaaggccgtccggcagcaggtccttgaagtacgcgcgcagttcggcgcggagccgcaactggccttcggtcggggcgaggtgcacggcgcaggcctcccggcatcgcatcatcgagggaacctgactgtccgtcagattcacccgcgatgtcaaggtcggggcgacgggagcggtgggcgcaccgcgtgcgcgagggcgcctgcgctaccggaccccagccggtccggtcgcacagacgccctcaagaatcggagtggctcaggccgcgactaccaccaggggaggaaatggaccgcgacggccgaattggactggtcgatcgcggtcaaggccgagccgttcacctgagcggtgttgttctggttggaggcgccggaaccggtggccacctgctgagacgtggacgaattgccgttgttgttaccgcccacgccgctgccgacgatgctggcgacgctcgcattcgatccgtcgttcgcgaaggagccgttgtcggccgacgccaccccgccgaagagggcagcgacgagggggagagcggcgacggcggcgatgacgcgggcggtacggatgcttgccatgtcttgatcctccaggaaaccgaagtgggaattgttccagggcagttggccgaccgcctcggtcgtttcgtgtggtgacgacgtcgcgagaccagagttgcccaccgaatccccggcgaaccaccccggagtccccgattcccccgcaagtatgaccaacatcggataaaccccattcccatgcttgaagcccgaggtcagcgccccggaagcggctgcatccggcgccgcacaagaggcgaaccgttccgccagactgccgtgtcccggacatgccgaaaggggccgcgcgtccgggaaccccaccgtctcccgggcctgcggccctgcaataccaagcttcacgccccctgcgtgcccctgcgcgccccggcgtgagccggggtgatccatccgtgccccgctccgggggcaccacctagcgcgatccacggccatgaccgaccgggctccagcgcctgttgccgaacctgctgacgctctggttcctgctgatcctcttgctgctgcttccgctactgctctgcgctactgccgtggccacgagaccaccgggctacgggactacgcggcgagggcgagtgcgccccgggcaccaccggcgccgactgtggctttggctgcggctgcggctgcggctgcggttttcgtggcaggcgccgcgatggccgcggcaggcgctgcgaccggggtcagcgtccgggaggcggtggccgtacccgcgcccatggctgcggcggtggtggagcgtcgtacggaaggggtcttgccgtgcgcctcggcgcggatccgctgcttgatggtcggcggcagcgaaccgccccgcatcatcgcccgccaggtccgcctggccgcgaaggccggccggcgtacggcggtggccgcggtgcccgcagcggcgggggtggaggcgacggcctgggccgaggccgacttccccgcgagaccgaagccggagaggagggccaccagggcggcgaggacggaggtccagatcgacgtgaggatgctgcggtgagccatgacgaggtgcctcgattcacgatgttcggacgggcggatctgaatacattcgtcatgatgtggccgcaaccgcaccatccccacgacccgcgccgatcttccgacaaacaccacccggaaggcccaaggccgtggccgagacctccggccgccctgccgggagccatcggaaacctgcacccgaaacccgtcctgacctgcggattttccccggcacgcccccgccggaccggcaagccgggaatcgcctcccctgcatcgccgagcgggtgacggagaagctgggaccgtgtacctctacctgctggacccgcacctggagcagggccggtatcccgcctcctccgcatccatggccagaatccaacgggcctcgcccggacgtctgccttcaccgccgatcagtccgcagtcgacgtcactgtggaagacgtcccgccggtcgggtgcgcttccgcgtacgagcaccgccggctgtccccagcccctgaggagagcctgttccttgacctgaagcgctgctcgttgcccgggtagcggatcgtgcgccgaccgcagctcggcggccaccagctctttgcagcgcctgtgctcctctggatcgcccgcggcctccgcttgtcgcatccactcctgcgcccttgcccgatgctcctctacagcccgggcccgtcgatggtcgtacttccgctggccctccaggagccacaagagctgctcagaccacatgtacgaccccgcatcgtcgggccctgatgcctcacagacaggaagcgttggagcagccacgagtcgtttcccaccgtccgtcgtcgggaccctggcgtgcccgggtggcaggccggcgaatccgctgcctcccgcctgcgcaggagaaccatgctgtcagcgcatgggggacgcctgggggacaaagcctgatcaagaacgactcacgggtgagaagcggtgagacagttcgaatacaagaggggtgcctcctgactcggaagcacccctctgacctgagccttggcccagctgtggcggtgggtgtgggatttgaacccacggtgactcgcgccacgacggttttcaagaccgttcccttaggccgctcgggcaacccacctggccggtacagagtaccggccaggtgggggtggcgggagcggcctgagaggtcaggacgcctgggccttgtcgtaggccgccttcgcctcgttgccgaagtacgggccgtacatacggttcggcaggaaggtgtagccgaagctgttcaccgagacctgggtgccaaggcccgtggcctcgttgaagtcctggaaccaggggccgccgctggaaccgccggtcatgttgcagcccaggccgtggtccttggtcagcaggaagtccttgccgctgttgccgctgcagtagaccagcttggtgccgtcgtacggggccgccgcggggaagccgaaggagtacatcttcttgttgtagccgccgttgaaggcgatgccctgggccccgacggcctggctgagggtctgcccgttcagcggggcgacgacggcgaggccgacgtccatgttcatgtcctcgctcgcggcccactggtcggtggcgaaggtcttggtggccgaccactgcccatagggcgcggagccgttgttgtaagccgggacgaagacccagttcgtgtgccaggccccctggtacttcacgcagtggccggccgtgatgaccgtgctgccgttggcgctggtgaccgagtcgccggagcaggaggcggtccggtcgcccatcgtgaagaagacccggcccgaggtcttcacgatggcgccgccacccgtccaggcgccgcccgcctgcgggaacgccgtgggggacgctgcctccgtcggcgcgacggtcgtgggggccgccgaggcggcgacccgggtgcgggccgtgccgggggccgccgtcacgtcgagcggggtggcgccacgcatccgctccgcggtccagaagccctgggtgtgctgctgccggaaggacgcgggggccgctggggcatccgctgcgatcgatggggtggccgccgtcagggcgcccgcgaccagggcgccggccgcgagcaggacggacaaggccgtgcgatgacgattcacgcatgactccttctgccgtgcccgggccgggtggcgaagccgggcagggtgggggtgaagagcggtcggtgcggatcggctgtgcgcggttcgtggtgcgtcgtacttgctgcgtcgtgcgtcgtgcgtcgtgctctgtgcgtcgtgcgcggtacggattgccgggggcagagtggcacgggcgcgtcgcaatgtcagcgggcagtcggaacgttcggtcggttccggccaggaaatggccaactcgccgccgttgtcgcctcatacggtgagcatcacgcccgcgtacgaaaccccggccaccaccacccacgccccgagtcccagtgccgcggcccgcccgccggtccgggccagcgtcggcaggtgcaccgcgctccccaggccgaacagggccgccgccagcagagcctcctgggcggtgtgcgcccactccagcgctacgtcgggcagcacgccggtggcgcggagcgcggccgccgccaggaacccgagtacgaacagcggcaccggcgccggcctgcggcccgaggcggtacgcaccccgcggcgccgggcccgtaccgagaaggccacggccgccaccagcggggcgagcagcgccacccgcatcagcttgaccagtaccgcctcacccagggctgcggggcccgcggtctgcgcggtggccacgacctggccgacgtcgtggaccccggcgccgacccagcgcccgaaggcagggtcggagagtcccaacggcccctggagaagcgggagtatcgctatggcgagcgtcccgcagagggtgaccagtgccaccgaggcggccacatcctcctcgtcactgccggacacctcgctcacggcgccgatcgccgaggctccgcagatcgagtacccggtggcgatcaacagcggctgatcgccgggaagtcccagtcggcggcccagccagagagtgccgaggaaggtcgccgcgaccacgccgaccaccatggccaccgtggcccagcccagccggagcacttggtccagccccaggccgagaccgagcaggacgatgcccatccgcatgagccgacgcccggccagggagagtcccgggcgggcggccgcgcgtacgaacgtccgcaggcccggcaggtgcgccaccgcgatgcccagcaccaccgacgcggtcagcatcggcacggcgggcacgagacggtgaatgcaccaggccgtcagcgcaccacccgccgccatcgccaacccgggccagggacttggtgtttcacgtgaaacatgccgaaccgccgtgctctgtgggcggtgaaggagggccatcagtcgacggggagcgtgtagacacgacggatgctggtgcccagccgggagacgtcggcgccgtacacgtgcaccgatatcgccttgccggtacaggagttgcgcaccttgtggatgtcaccgggcggggcgaacccgcagacgtcgccctgggcgttgaccacgtcctcggtggccaccagccgggcgggaccggcgcccggcgcgagccggaagcggcgttcgctctcctcaccctgatggactccggccacgcaccacgacacgtggtcgtggatgcaggtctcctgcccgggcagccatacgagcgcgaccacggagaagctgccgtcggattcggcgtgcaggatgtgctgccggtaccgctccgggtctccttcctgctgggccggggtcagcaggtcgggcgcgcccaggtgcggggcgagccgttcgcccaccaggtaggcggtgagatcgggagccagcccccgctccacgaccgtgcggatctcactgacgagggcggccatcctcgtggtggtacgggccggcgtggtggtggtcatatcggcagcgtgctgccgaccttccatcacgtccaacgacagttatgacctgaaatcccaagcactgcttatgggttggtcagcagccgacgcggttcgccgccacctgtttcagcgccccgagcaccacggccgtcgcggggatccgcagatggtcgcggtagacgtacgcggcgatgtgccggcgggcggtgggctggagggcccgcccgcagaccttgctcagcgagagggagggcagcaccagcgcgggcatcatcgccacgcccagtccttgagcgaccaggctctgcaccaccaggttgtcatcggtggagaagcggatgtcgggcacgaaccccagctccgcgcactcgtgcagcaggttggcgcggcagcgcgggcagcccgcgatccaccgttcctcggcgaggtcggccaggtgcacggcgcggcggcgagccagtggatgcccggtcgggagcagcaccgtcagctggtcctccagcagcctgacctcggagacctcctccgggatctcctcgtggaggccgggataggtgaaggccagggtgatgtcgcactccccgcgttccagccggcgcagcgactcgggaggctccccttccagcagttccacctgtatgcccggatggtccttggccaggccgctcagggcctcggggacgagggtgacattggcgctgggaaagccgcacagcctgacccggccggtacgcagccgggcgtacgccctcagctgggcctcggcggcggagaggttgccgaggatggtctcggcgtgccgggagagggactccccggcctcggtgagctgcatcttgcggcccacgcgggtgaacagcggggtcccgacggcgcgttcgagcgccttcatctgctgtgtgatggcgggctgggtataccccagccgtcgggccgcggccgagtacgacccggaggcgaccaccgcgtgaaaggtccgtatgtgccgagaatcgaacacgagcgaagcataagcggacgttggaggggccgtaggcgaaatcccgcctacggcccctccacatcgggccgccgccgcgaccggtggtgctcgggtgccgttacttgtcgccgatccgcgagccgagcgtgatgtcgaccgtggtcggcttgccgccgcgcaggtaggtcagcttcacggtgtcgccgggcttgtacgtccagatcatgctgatcagggtcggaccgctgtcgaccggcttgccgccgaactcggtgatgacgtcgcccggcttgaggcccgccttgccggcagggccgttcgggtcgaccagctcgttggcggccccaccctgctcggagatcttggcgccctcggacttggcctggaggtcgacggagaccgagatcaccgggtagaccggcttgcccgtcttgatcagcgattcggcgacgttcttcgcctggttgaccgggatggcgaagccgaggccgatggagccggcctggccgccgccgaagccgccgttgcccgccgactggatcgccgagttgataccgatgaccgcgccgcgcccgtcgagcagcgggccgcccgagttgcccgggttgatcgaggcgtccgtctggagggcgctcatgtacgagttcttgctgccggagccgtccccggaggcgaccgggcggttcttggcactcacgatgccggtggtgaccgtgttggacaggccgaagggggcgccgatcgcgatggtcgagtcgccgaccgcgaccttgtcggagtcgccgagcggcagcggcttgaggccggccggcggggtcttcagcttgaggacggcgacgtcgtagccctgggcgcggcccacgacctcggcgtcgtaacgcttgccgtcggagaacgtcgcgaagagcttcccgccgttcgccgcggaggccacgacgtggttgttggtgaggatgtggccctgctggtcgtacacgaacccggtgcccgtgccgccctcgccgtcgccggccgaggcctcgatggtgaccacgctgggcagggcgcccgcggccagaccggcgatggagccggcctcgcgcttgaggtccttcggggtgctcgcggcgctgatcgtggtggagccggtgccgttgttgctgcgctcggcggcccagtagccgacgccgccgccgatgccgcccgcgaggagggccgccacgagcactgccgcgatcaggccgcccttgcccttcggcttgggcgcgggtgcgccgtcggtggccaggggggcgccccaggcgccgccgccgtggcccccggctccgtacgccggcaccgtgggcggcgggggcggccagccctcggctccgtgcgcggccggggcaggggcctggccgtaggcctgggccggttcctggccgtaggccgggggcgcctgtgcgggcgggatctgctgggtgggctcggtgcccggcgcaggggtcggcgcaggggtcggcgcaggggtcggcggcagctgctgggtcaccggctcgccgacggcgggcgcgggggccgcatcctgcgtctcggaggccggagcagggggtacggacggggccgcgggaggtgtcggggccgcggtgccctcgttctcggtgctcacagcgctctctcctcgtcacacacggcttcggaaaattctctggcgattatcggtccgactgaacgttcgacgtgccgcacaagttcctgggcaaagcctttcccatgacccgtcagagcactgtaagccggacctgtgcgtctctccccattctttatatccgacatttcgcatgtactcccggggcagacccccgacgcccgggcacctctcggtggcaccatgacccggtgacccacgcaatgccgcgcaccatccaggtcgtcgcccaccgcggcgcctcggaggatgcccccgagcacaccctggccgcctaccgcaaggccatcgaggacggcgccgacggcctcgaatgcgatgtccggctcaccgcggacggccatctggtgctggtccacgaccgccgtgtgaaccgcacctcgaacggccgcggcgccgtctccgccctggagctggccgatctcgccgccctcgacttcggctcctggaaggaccgcgaggagtcccccgactgggacgccgaccccgagcgcacctccgtcctcaccctggagcgcctgctggagctggtgtccgacgccggacgaccggtccagctcgcgatcgagacgaagcatccgacccgctgggccggacaggtggaagagcgcctcctcgtcctcctcaagcgcttcggcctggacgcccctccctccgagggcccccacccggtgcgggtcatgagtttctccgcgcgctccctgcaccggatccgcgcgtcggcgccgacgattccgaccgtgtacctcatgcagttcatctcgccccggatgcgggacgggcggctgccggccggggtgacgatcgccggccccgggatgcggatcgtgcgcaaccatcccgccttcatccacaagctccagggcgcgggccactccgtgcacgtatggacagtgaatgaaccagaagacgttcagctctgcgctgatctgggcgtggaagcaatcatcacgaacagaccccgccaggttctgtcccaactcgggcgctgaagtccccttttgcacacccgccaccctcgacccgttcgttacagggtgtgccccggcgcatccgctccgcattcggtcggtgtgaatgcgtccgaggggcccgcttcgggccgcttcgacggtttccggtccaggccattggggcatccagaccatgcgtggggctaaggaggttccgggggtggcgttggtggtggcacaggaagtgcccacgtcgtcgtgcatggacgtacggcatggtcctgcgggcgtgggcgaggcgagacgccggatgcgcggtcaattacgcatgagcggagtgtccgaatcggtcgtggacgatgccgtactgatcctttccgaactgctcagcaacgcctgccgacacggcaggccgctcggctctcgggaagtcggggacggggagatacgcgccgcatggcgcgtcgacagagcgggacgactgacggtcgaggtcacggacggaggcgggcccacccgcccggtccctgccacgccctcggtcaccgcacggggcggccgggggctgaacatcatcagcgccctggcccaggactggggtgtccgggacggagcggcgggtgaggtcaccgtgtgggtgatcgttgcctgtgggccccggcacgaggatttcgctacgcgcgttgcgcccccggcgatcgacttcagcagggcgttcgacgacctcgatccctgaacccgggatccgcgaccgcacgacagcacgacagcacgacagcacgacagcagtaccggtcatccgcacaggcggccgaccgggagcgcacgccgaccgtgctcccggccgcacccaaccggttccggcggtacgaacggctaggctcgcgcccagacacgacgccgtaccgccgcaaccgggagacacgcacgatggccaagaagcgccccgcagccaagactgcaaagccgcagctcaacaacggtgaaatccccgtcgtgggcgcccgcgagccctgtccctgcggatccggccgccgctacaaggcctgccacggcgcagcggccgcgcacgccgtcaccgagcacgtgcggcgccccttcgagggactgccgggcgagtgcgactgggtcgcgctgcgcgagctggtgcccgccgccaccatcccgctctcgctcaagggcggtctgcccgagggagtcccctccgtcacgctggtgaccgtactgccgatggcgtggccggcgctgcgccgcgaggacgggtccgtcctcctcggcctgcagaacgactcgccctccggtgacctcgcccgcgacatggccgacaccctggagcgcgccctcgtggccgagcccggtaccccggtcgccgcccgccgggttcccgctgacggtccccgacttcaggatctcctggacaccgacggcggtttcgagccggttgtccacactgggttcgaattctggattccggaatccgagaacgcccagaacgcctcgccggagatcgccgcctcgctggagcgcgccaacgcggctgccattcccaccgtcaagctgaccggcgtggacgccgcgtactggtgcgagacgccggacaagaaccacctgcgctgggtcatgccgtaccccgaggagaagctgctcgacgccctcgcgcggctgcacgcggccggcacgtcctccctcggcgagggcacgaagctcgtcggctccttccgcgcccacggcctgatggtccccgtctgggacctgcccaccggggtcacggccgacgacgtcgagaagcccgcggcggagttcgcggagcggctggccggggccctggccacggacgccccgctgaccacggacgagcgccgggcgcgcggcggactgaccaaccgccaggtgacgctcagctgaccgggcggctcgcgcggagccggtgaccggagtcacaactcccgctaatcgtctgcaaatcggtgtctgaatatcggagatcgaatttgcgaacaggcgatctcttgttaccgttcttgtagcccggtcgctggtgcatcccccgtcgccagcgaccgggcccttgattttcagggtgcgatcaaccgtcacccgaggccggtgagttgctcccggacctcaggagcagttccccttcatcatccggaactgcaaattccgctacggccgagtagctctccggattcccggccgaagcctccctcggcgtctcgcacaggcccggttcgtcgcccgcgcccaccgcgcaccggatctggaccgtgcgcccggccggacccatcaccgtcagcaccgcgtccagcgcgcgaccacttgtgttccggtaataactccggccccacgtctggccttcaccgaccagcacgcaggtctgcgcctccaccccgtgcggcgaggacagttcgggtccgcatcgggaatccgtacgcggctgctcggccgggccgggctgctgcggtccggccgtcggcgacgagcgcgcgggatccgcgggggatgtgcgggaggagtccgaaagcccgagcgccgagaacaggccgccgccctttccgtcatcctgaccggcaaaatccggcccggcgatcgcgccggcgagcgggagcgacaagatgatcaacacaccggcgccgataccgatcaggcggagattcattcgccgaagatagcgaggagggaatggggctcggagatccccgcgcccaattcccttggaaactcgtcccgctgacacccgtacgagtgatcctcccgagccccgcacctccccgcgggcaagctgcccgcgggtcccccgcagggcccggcaggtcagtacgcgagcctgctgccgccgccggacgcaccgctgctggcctcgaccagcgcgtccacgaccgcctcgatctcgggcagccagaggcttcccgccggcgcctgcggcgaccgcgccgaccgcccccgcagctgctgcgcctgcgccgtctgcgcccgaggctcacgttcccaccgcacctggccgccaccgctggacgcggcggagggcggcagcaacaggtagccgccctcgccgtggaaccgcagcgaggagggcacgtggtccttcgcgtacaggagttcgccgagccgctccagcgagtagggcgccaccagcagcgcccagcgggtgggtgtggccacgaccggaccgagccgcatgccttgcgcgtccagtcgtacgagggcacgcgcggccgcgccggccggcaggctcaccgcgcacggggcggtcccgccggtggccatgaggacgggggcggcgggccggttggtccaccaccaggccaccatccgggggtcggtggtggcggcgagcagtccggggtcgaaggggtgcgcgccggggacggcgcagtcggggtcggggcaggcgcatcgcttgccgtcggcgccggaccggcccacgccgggcacgacgggccactgccaggtggtggcgcagacgagcgccgcatcgaggagagtcgacgtgtcgccgctccgtcccgggtcggggcgcagggattgaaagcgatcgcggagccgctggagacgccttccgaggatctcgcgcatgtgcgctcgttcctttccgttgaacgccgagggccacatcacaccatgtaaccggtgtctcaccacacgtacaggtttcgcgtcactgtccgccagaagcaggttcacacggttcgtgcagtcttcttacaggtccatcaaacgtcccgcgggggtggagcacgacccgcgccggccaccgagaccggcggccgccgctaaggacgacggtccgtgccgggtggttcccggcggccaactggcctcgcccaccaccgagtacgtacccgaggcccctgcggagcccgctcagtcgatcgcaaaaacctactgcttccagctttttccggccaagttctagccttggctcgacggtgagttgcggtcccacggacaccaggattcccacctggacaatgctggacatgcatccacgtgtgcgtgtagatgtggattccttgatggcggcgcagcacgatctgggggtttgcgatgctatttggcgaatcgcaccaggtggaaaggcggacgccatgagcgccccgcatctgccgaaagtggctggaatcgatccggtggtaaccacgccacctcacactgcggcgcccacgcccgcccggaccacccccgcaccggcccctgcgcccggcggcccgggcagtgtcatccaggaccggctggcgggcatggtctcggacctcaccaccttgcacgagctcaccgagcgcctcgcgcgcaccagtgacctcgactcctcgctccgcgagttcctccgcgccggcgccgcgctcgtcggcgcccgccgcggcctggtcgtcctggagccctccgacggactcggcccgtccagcacgatcggcctcgggctgggccacgcggagctcggccacatcgagaccgtgccgcgcagcgccacctcctacgggcggatcctcgacgggctgcccgacgcccagggcggctccgagttcctccccgaaccgggcgcgccccccggatccgggggtttcgacgcccccgtggacccccgccaccgcgaggtcgccgcccgtctcggctacgccgcgagctactcgctccccctcaccgccgaggccaccggccggctcggcgcggccgtctggctctacgacgagcaggcggagccgagcgaccgccagcgcgacctcgccgggctgtacgtgcgccacgccgccgaacacctggcccggatgctggaggtggagcgctcccgctcgcacctggccaccgtctccgaggagctgctgccgagccggctcccccggatccccggggtacagctcgccgcccgccaccacacggggccgctcggcgggggcgactggtacgacgccctgccgctgccggagggtgctctggggctggccgtcggctccgtcaccggctccggaccgagcgccgtcgccgcgatggggcggctgcgcgcatcgctgcgcgcctacgccgtcatggagggagaggaccccgtggcggtcctgtccgacctggagctgctgctgcgcctcaccgagcccgcccgctccgccaccgcgctcttcgcctactgcgaacccgccggaggggctcagggccagggcaacaagatcatcctggccggcgccgggcacaccccgccgctgctgatcggcgagcaccgcaccgagtacgtggagacctcgctctccgcccccctgggcatgctgtcctgctgggaggcgccgagcgtggagatcgaacccgcacccggagaaacggtgcttctctacaccgacgggctgctgcaccacacgggcgacccgatggaccgcgcctacgcccggctgcacgccgccgccgcgggggtcccccgcagcgtccgcgaggacccggcggccctgtgcgagcacatcctgaagaccgtgctgcccggcgggcggccgtccgacgcccccgaggacatcgtgctgctcgcggcccggttcgaatgaggcccggagcaggttccgaatcgtgacggacggcacgattcggaacctgctctctccgtacacgcatacgatggatgcggtccacacccaggtccgtaccgtcgtagctgaggagaagacgtggctgacgagctcaccccggagaccccggaagaagagcagcccaagaagacgcacaagcagcgcaagaacggtctgtacccgggcgtcagcgacgaactcgcggagaacatgcgcagcggctgggccgacaccgagctgcacgggctggagcccatcgctcaggccgcccacaccctcgcccgccgtgacgcgctgtcccggcgcttcccgggcgagcgcctcgtcgttcccgccggccgcctgaagacccgctcgaacgacaccgagtaccccttccgggcctcgaccgagtacgcgtacctcaccggtgaccagaccgagaacggcgtcctggtcctggagcccaccgggccgaccggccacaccgcgaccgtgtacctgctgccgcgctccgaccgggagaacggcgagttctggctgtccggccagggcgagctgtgggtcggccgccgtcactccctcaccgaggccgagcagctcctgggcatccccgcgaaggacgtccgcaagctcgccgaggctctcaccgaggccgacggcccggtccgcgcggtgcgcggccacgactcggtgatcgaggccgctctcaccgacaaggtgaccaaggagcgcgacgaggaactgcgcgtctacctctccgaggcccgcgccgtgaaggacacgttcgaggtcggtgagctgcagaaggcggtcgactccaccgtccgcggcttcgaggacgtcgtgaaggtcctggacaaggccgaggccacctccgagcgctacatcgagggcaccttcttcctgcgcgcccgggtcgagggccacgacgtcggctacggctccatctgcgccgccggcccgcacgccaccaccctgcactgggtccgcaacgacggcgacgtccgctccggcgacctgctgctcctcgacgccggagtcgagacccactccctctacaccgccgacgtcacgcgcacgctgccgatcaacggcacgtacaccgacatccagcgcaaggtctacgacgccgtctacgagtcccaggaagccggcatcgccgcggtcaagccgggtgcgaagttccgcgacttccacgacgcctcccagcacgtgctggccgagaagctcgtcgaatggggtctgctggagggcccggtcgagcgcgtcctggagctgggcctgcagcgccgctggaccctccacggcaccggccacatgctcggcatggacgtccacgactgcgccgccgcgcgcaccgaggcgtacgtcgagggcaccctggagccgggcatgtgcctgaccgtcgagccgggtctctacttccaggccgacgacctgaccgtgcccgaggagtaccgcggcatcggcgtccggatcgaggacgacatcctcgtcaccgaggacggcaaccggaacctctccgccgccctgccccgcacctccaccgaggtcgaagcctggatggcacgcctgaagggctgacgtccgcgcgtcgcgtgtcggtgggcgggattcctgtacggggtcccgcccatcggcgttcccttcccgggacgcccacggcgcctacggcgcctacgacaccttcagcagcgcgtcgtcgcgccacttcagcatcttgtcgaagctcaccaccgcgccgcggcccggccggttgcggaagcggacgtggtcggagagctcggcgatcaggtgcagaccccggccgtgttcggccagggagggtctgcggcgggccaccgtcgcgggcgggaaacccggaccggaatcggtcacctcgatgtggcagcaatccccgtccagataggccgtgacgtggtacgcctcggcatcgtccgggatttcgccaccgccgccgtgctccaccgcgttcgcacacgcctcgctcagcgccaccgagagatcgaaggagatgtccgggtccacccccgcggtctccatggtccccagcagcagtcgcctggcgagcggcacgctcgcggcttcgcgcctcaagtggagagaccaccagatgctcatacggttacctattgccgcccgcgagggggcgtaagcgccccgcggccgtccgagacctcaatacgcccgttcggccgacgcggctctccgggggagcggtgtatgcggcggtccccagcgggaccggaccgtctccgcggagcggactcatgcggaccttccggacctgccgtatgaagtgcgtgaacgcagtgcgatgatggcccggccatgtctgacccccacgcgacgcacgccggagccggcctccggctgatccgggccgcggtgttcaccgcggtctgtgtcgtgctgtccgcgaccgggcacgccctggcgtcctgcgccaccgtgccctggtggtccctctctctcggcttcctcgccgtcttcgcggccgccgccctgctcgcgggccgccggcggacgctgcccggcatcgcagccggcctcaccgccggacaactcggcctgcacgcgatgttcggcctcggccagcacagcgccgcggccgcgcaggcaccggccggcaccgccgacgcgtcgctcgccgagctcgccgcacggctggtgtgcgggggcaactccgtaccgctcagcccggccgacgcccggcagatcctggaagccgcgggcctggacccggccgccctggccgagcagacggcacaggccgggcaggtcgcggcgcaggctcacggcacgcacgcgcacgtggcccaggccgttgccacggcgcccgcgaccggcctgttcagcccggccatgctggtcggccacctgctggccgcgctcgcggcgggctggctgctcggccgcggcgacgccgcgctcttccggctggtcgagctgtcccggcgctccgccgaagccgccccgacgcgtccgctgcgcgccgcactggccttcgtacgcgccctcggcgccgggctcgcgggctcggccgcacgtactcctcagggcccccggaccgggtccgaccccgccctctgcacgggccgggaagcactccagcacacggtgatccggcgcggcccacccgtggcactcgccctcgcagcctgacgcggcacttcttcccggacgcagagcgggataccggtgccgcgaactccgcgcgcgcccgtgcccggagccatcgccaccaccgcttccctggagtgttcccgccatgaagacctctcgcgtctccttcgccgccgccgtcgccgccggttccgtcctcctcctctccggcccggccttcgcccacgtcggtgtgcagcctgtcggagaggccgccaagggtggctacgcgacgctcaacttcaaggtccccaacgagcgcgacaacgcgtcgaccacgcagctggaggtcaacttcccggtcgaccagccgctcacgtccgtcatgccgcaggacatccccggctggacgtccaccgtcgagaagaccaagctcgacaagccgctgaccgtgcacggcaagcaggtcaacgaggtcgtcaccaaggtgacctggaccggcggcaagatcgaggccgggaagttccagcagttcccggtctccgtcggcaagctgcccgagaacgccgagcagatggtcttcaagtccatccagacctacgacaacggcgaggtcgtccgctggatcgaggaagccaaggagggcgcggcggagcctcagaaccccgcccccgtcctgaagctgaccgctcccaagggcgacgaccaccacgacagcggtgccaaggcggacgagccgaagaacgccgacaaggacgccgagcacggccacgacaaggccgcagccgaacacggcaccgacaccaccgcgcgcgtcctcggcatcgccggcatcgtcgtcggactcggtggggtcgccttcggcatcgcctcgcgccgccggtccgcctgacccctcgcgcccatgggcgctgccgttccgctacgtccgtaacatccccgatcccagggacatttcttcatgcgcaccacacgtgtgacggtcgccgcgctgctcgcggcggccgcactcaccctcaccgcctgcggcggtgagcccgtcaagccgagcggggtcacccagatctccggcgggcagagcaacgccaaggccgcgacggtcctggaccgccccttcaacaagccggagctcgtcctcacggacaccaccggcaacccgtggaacctgcgcgagcagaccaagggcaagccgaccctcatctacttcggctacaccaactgccccgacgtgtgcccgctgacgatgagcaacatcgccgtcgccaagaaggcactccccaaggccgagcaggacaacctccgggtcgtgttcgtcacgaccgaccccgagagggacactcccgagtccctcgccgcgtggctcaagtcgcaggacccgtccttcgtcggactcaccggggacttcgcgaccatccaggccgccgcgcgcacgctcggcatcggcatcgatcccgcgacgaaggacgccaacggcgacgtcgtctccatgcacggcgcccaggtcatcgcgttctcgcccaagaccgacgagggctatgtcctctacggcgagggcaccaccgtcgacgactacaccagggacctgccgaagctcatcaagggggagaacccgtgaacgcccgcaccactcgcaccttcgccgccgccctctccctgacggcagcactcgccatatccggctgctccggcaaggccgagccgaagatgaccgtcagcggcgccttcatgccccagccggtgaacgacaagatggccggcgggttcctggtcatcaagaacggttccgggaccgccgacaagctcaccggcgccacctcctcgctctccgacgatctccagatccacgagaccaaggaccagaagatgcagcaggtccagtcgatggacgtccctgcgaacggcgagctccggctggagcgtggtggcaaccacatcatgttcatggggctcaagagcacgcccaagatcggcgacaaggtcaccgtcgagctccgtttcgagaaggccggtccggtcaaggtcgaactggacgtgaaggaccggacgtacaacgcccaggctccgagcactgcgtccggccacgcgcactgacggatcgaggagctgacacgccatgacggccaccgcccccgccccctccacggcccatgcccgtgccgcggcgctcctgccgcggctcgcgctggtcctcgcagcgctgctggcgaccctgttcaccgcggcctcaccggccacggcgcacgccgcactcaccgcgagcgaccccgcggacggggcggtggtcgccacggcccccgcccaggtcacgctctccttctcggagcaggtggccatgggcgacgactccctccgcgtcctcgacccccagggcagacgcgtggacaccggtgagctgcgcgacatgtgcagcgggaacaccgtccgctacggcaccgcgctgcacaccggactgccgaacggcacctacaccgtcgcctggcaggccgtctcggccgacagccatccgatctccggcgccctcacgttctccatcggcgcgccctccgcaaccgatgtcaccctgcccaccgcgcaggcgggtggcggacccgtcggtatcgcgtacgggatcgcccgctacgccgcctacgccggcttcaccgtcctcgtcggcggcgccgccttcatcctgctgtgctggcgccggggcgccgccgaacggccgctccagaaactcgtcgtgcgcgcctgggtcaccctgaccgcggccaccctcgccatgctggtgctgcggaccccgtacacggggtccggcgatttctccgacgcgttcgacctcgacgggctccgggccgtcctggagaccaaggccggggcctcgctcgtctcccggctgctcctgctgggtgcggccgccctcttcctcgcggtcctcttcggcgtctacgcgcgccgtgtggcggacatcggacccgacgaggccggccggggcggggaggaaaccgccggtgccgaccgggccgacgaggccgagatgccggacgacaccagcgacctcaccttcgggctcgccatcggaggcgccgtcgtgtccggcggtatcgccgccacctgggccctctcggagcacgcctccaccggaatccagcccggtatcgccatgcccgccgacatcctgcacctgatggccgtcgccacatggctcggcggtctcgccgcgctgctcgtcgccctccacaaggtccccgggatcgagcgcgcggccgtcaggagcttctccaaggtcgccttcgtcagtgtcctggtgctcgccgtcacgggtgtctaccaggcctggcgccagctcggcagctggtccgccctcaccggcaccgactacgggcagctgctgctcctgaaggtcggtctggtggccgtcctcctcggcatcgcctacgtgtcccgcaggtggaccgcgaggctcgccgacactcccgcggactccacgggggtatccgtcgccgccgggcacacctcggacgatgtttcacgtgaaacaggccctggcaccgtctccgaaggctccggtgtttcacgtgaaacagagcccgcgcccgtccccgcggacccggagcgcgccgcccagctcgcccggcagcgggccgcccgcgagagcgcgcgcgagaagcgcgtacgggacgccgacccggaccgtgccggcctgcgccgctccgtcctcgccgaggcggccatcgccgtgatcctgctcgccgtcaccacggtgctcaccagcaccgagcccgggcggaccgtggagaaggagacgggccgcggctccacctccaccgccgtccccgaccgggccgtcaagatcaccctgcccttcgacaccggcggtccgaacggcaagggctccgtccggctcgaactcgacccggggcgggtgggcgcgaacaccctgcacctctggtccgagtccgtcgacggcacccccttcgacctccccgagatcaaggtggcgttcacccttcccgccaaggacatcggccccctgccgctcgtccccgagcaagcggcccccggacactggaccgcatccggtgtccagctgccgctcgccggtgaatggcgtatcgacgtgaccgtccgcacctcggacatcgaccagaccaccgtccagaagaccgtgaagatcggctgatcagcgtgaccgagagcaaccccgacatcgagatctcccggcgcaggctgctgggtaccgtcggcgccgcaggcgccgtcgggatcggcctcggagcaacaggcggcgccctggcgcactccgtgctcgccgactccggaagcggctccgcgcccggctcggcaggcggcctggcctccctcggcgccacccaggtggccttccacggggaccaccaggccggcatcaccaccccgctgcaggccaaggggcacctcgtcgccttcgacctcgccgccggagcggggcgtacggaggccgccgcgctgctgcggcgctggtccgacaccgcccgacggctgatggcgggcgagccggcagcctcctccgacagcgggatcgccctggacgccggtccgtcctccctcaccgtcaccttcggcttcggccactccttcttcgagcgcaccggcctcaccgcgcgccgccccgccgcgctcgacccgctgccggacttctcctccgaccggctggacgcccagcgcagcaacggcgacctgtgggtccagatcggcgccgacgacggtctcgtcgccttccacgccctgcgggctctgcagaaagacgccggagaggccgcccgcgtccgctggcagatgaacggcttcaaccggtctcccggcgccaccggcacgccgatgaccgcacgcaacctgatgggccagatcgacggaaccggcaatccgaagccctcggagcccgacttcgacaagcggatcttcgtacccggcgcgggccccggacccgccgagcacgcctggatggccgggggctcgtacgccgtcgtccggcgcatccgcatgctcctcgacgactgggacaagcagtcccccgcccagcaggagcaggtcatcggccgtacgaaggccaccggtgcccccctgaccggcggtggcgagaccaccgagatggcgctcgacaaaatcggccccgacgggaagcccgtcatcccgtccaacgcccacgcccggatctccgcccccgagcagaacggcggggcggcgatgctgcggcggcccttctccttccacgacgggatcggccccgacggcgctcccgacgcggggctcctcttcatctgctggcaggccgatccgctgcgcggattcgtacccgtacagcgcaagctcgaccgcggcgacgcgctgtcgcaattcatccggcacgagtccagcggcctgtacgcggtcccgcccggcccccgcagcggcgagtacgtggggcagcggctgctcgaaggatgaacagcaatccggcaggcggcaccccggcattaggctgatcgcatgtcagccacccgcttcacgtatctcggtcccgagggcaccttcaccgaggccgctctgcgcaccctgccggaagccgcgacccgggaactcgtcccgatggtgtcggtcccggccgccctggacgccgtgcgcaacggcgaggcggccgccgccctcgtcccgatcgagaactcggtggagggcggggtcaccgccaccctcgacgagctggcctcgggcgagccgctgatgatctaccgcgaggtgctgctccccatcaccttcgcgctgctcgtgcgccccgggaccgccctgtcggacgtcaagaccgtcaccgggcacccggtcgcccagccgcaggtgcgcaactggctgcgcgcgaacctgcccgacgcggtgtgggagtcggccgcctcgaacgccgacggcgcccggctggtccaggagggccgcttcgacgccgccttcgcgggcgagttcgccgccgccacctacgggctcgtcccgctggtgaccgagatccacgacgcggagaacgccgagacccggttcgtgctggtggggcgcccggcccggccggccgcgccgaccggcgcggacaagacctccgtcgtgctgtggctcggcgacgaccaccccggtgcgctgctggagctcctgcaggaattcgcggtgcgcggggtgaacctgatgctgatccagtcccgtccgaccggccagggcatcggcaactactgcttcgccgtcgacgccgaggggcacatctccgaccggcgggtcagcgaggcgctcatgggcctcaagcggacctgtccccaggtccgcttcctcgggtcctacccgcgcgccggtgtcgctcagagtgatgtccgggctcctcggcccggaacctccgacggtgacttcacagccgcctccgactggctggggcgttgcctcgacgggcgggcgtaggacgtcgtccactgtccacagagttatccacaggcggagacgggaacctggggacaagtcgacagtacggcgcgacaaggtcgacaaatcacccggggagctcaggtttcgctctggggagcggaaggtgaacggtgtcacccccgcatcgccgatcaactctttggggcgagtcattcccacccgaatgagtgtgtgggggtggtttgaaccctgattcgtcccggccgcccatcgatcaggaatgatctattcctgtgtccacagagtcggcacacagcctgtggataagatccgggccccggcaattcctgtggacaagaagtccctccagccctgctcagggcccacccggccgtcggcattctgtcccttttcagggaatgggaccgcttttattgacgccccgagacggaccacttccggtcagccatcaagacttatccattcgttgcaattgggacatagcgacacgcagcgtgatatcggtgtgatcccaggaaccccagcccggtagcctggaggggtgattgacctccggctgctccgtgaagaccctgaccgtgtccgcgcctcgcagcgcgcccgtggagaggacgtcgaactcgtcgacgcgctgctctccgccgacgagcgccgcaggtcctccggcatgcgcttcgacgaactgcgcaatgagcagaagtccctcggcaagctcatccccaaggcctcccccgaggagcgggccgagctgctcaagaaggccgagcagctcaagcaggacgtcaaggccgccgaggccgagcagaacgaggccgacgaagccgccaagcagcttctcctccagctcggcaacatcgtccacgaggacgtcccggtcggcggcgaagaggacttcaccgtcctggagacgcacggcaccatccgcgacttcgccaccgagggcttcgagcccaaggaccacctggaactcggcgaactgctgggcgccatcgacgtcgagcgcggcgccaaggtctccggctcgcgcttctactacctgaccggtgtgggcgccctgctggagctggcgctggtcaacgcggccatcgcccaggccaccgaggccggcttcatcccgatgctgaccccggcgctggtccgcccgcgcgccatggagggcaccggcttcctcggccaggccgcggagaacgtgtaccacttggagaaggacgacttctacctggtcggcacctccgaggtccccctcgccgcgtaccacatggacgagatcatcgacgccgagaagctgccgctgcggtacgccggcttctccccgtgcttccgccgcgaggccggcacgtacggcaaggacacccgcggcatcttccgcgtccaccagttcgacaaggtcgagatgttctcgtacgtcgcgccggaggacgccgaggccgagcaccagcggctcctggaatgggagaagcagtggctgaccagcctggagctgccgttccaggtgatcgacgtcgccaccggtgacctgggctcctccgcctcccgcaagttcgactgcgaggcgtggatccccacccagggcaagtaccgcgagctgacctcggcctcgaactgcaacagcttccaggcccgccgcctgtcgatccgctaccgcgacggcaagaagacccagccgctgtccacgctgaacggcacgctgtgcgccgtaccgcgcacgatcgtcgcgatcctcgagaaccaccagcaggccgatggttcggtacgggtgcccccggtgctccgtccctacctcggcggccgcgaggtcctggagccgatcaccaagtgagcccggccccgttcccgtacaagctcgtcgcgaccgatctcgacggcacactgctgcgtggcgacgacaccgtctcggaacgcacccgtgaagcgctcgtcgcggccaccgcggcgggcgcggcgcacatcgtcgtcaccggccgggccgtgccctggacccggcacgtgctggacgatctcggctacaaggggatcgccgtctgcgggcagggcgcccaggtctacgacgcgggcgcgcaccggctgctgacctcggtgacgctggaccggcagctggccggtctggcgctgtcgaagctggaggccgaggtcggcccgctggccctcgcggccagccgggacggggtggacggcgaggtgctgttcgggcccgggtaccaggtgcaggaaggccttccggccatatacctggacgacaccaaggcgctctggaccgctccgctgaacaagctctacatccagcacccggagctggacgacgacacgctcgtcaagatggcccgggcgaccgtcggcagcctggtcgacatcgtgatggcgggccccggcatcgtcgagatcctgccgctgggcctgaccaaggccacgggcctgtcgctggccgcgcgccggctgaaggtgaaggcggcggagacgatcgccttcggtgacatgcccaacgacatcccgatgttcggctgggccgcgcacggggtggcgatggccaacgcccatgccgagctcaaggccgtggccgacgaggtgacgacctccaacgacgaggacggcatcgcggtggtgctggagcgtctgctgggcgccgcgtagcccgcaggacgcaggacataggacgtaggagaggtccgggacagcccgcgccgcaggcgcgctcgaagtggctgccccggaccttttgttgctccccgcacccctcactctgcaccgggtgcaggtctcttaccagcgaatttccgtgcatcagccgtacgtcagccgtggatccggcggcgccgccagtaggcgacggtgaggatgcccagcagcggcccccagagcagcaggggcgcataggacaggtcgaagatccggagggcgagcccggtgggcgcgtcgggattcgcggcgttgacctcgctccaggtccaggcgccgagcgtcgtgatgccggtcagcgcggccgcaccgaacgcggcgggaaccaccgccgtcagggggtggatgcggcgcccgcccagcaccgggacccagcggggcagcacctcgccccagcgctggaccagaccgaggctcaacaggcccagacactcctgcaggacggtgacgaagacgagaaccagggacgcggagccggggtagtacgagtggtgcagatcgctgcccgggccccagcccatgggaatgccgaccgcgatcgcgagccgccacacacagctggggaggacggtcagcgaggtgagccgggcgagcctgcgcatccccggagagactccgggcacggtgtgcgaggtgcggacggcgttgtcggaggtcatcttccaagtccatttcaggaggggctggttgatgactcaagcctggtcggccggggccttcgcagccatccgccgatcagcaggccgacgggtccacggcggcccgtacggctctgccgatcggcagatggccggactccggggtgcgctcgtagggtcggggcatgaccgccaacctccgtgccgcgtatgccccgttactggccctggccggcgtcgtcggcctcctcgcggcgttcctgggtgcgtccccggcgtggtcgctgatctgggtgggtctcctgctgccgctgctggtgctggttgcccgctggtccccggtgcatccgggggccgtcgcggcctctctgggcgtggcggccgtcgcggtgtggcccgtaccgctgatgtggggaacggcgtcgtggctggagatctgcggggcggtggcgttctgggcggcgcccgcgctcggcgcgctggcggccggggggtatctgcgccgtcaggcgagccggatgcgccaggccgtccgggacagccggcgcgaccagcagctggaacttgcccgggatctgcacgacttcgtggcgcacgacgtgagcgccatcgtggtgcaggcacaagcggccaggttcgtggcggacaaggaccccgagcaggcggtccgcgcactggagcgaatcgaggcggcggggctcggcgcgctcgcctcgatggaccggacggtgcacgcgctgcgggaggcggccggcgcgcggtccgccccgatcccggggacctcggagttgccggggctcgtggagcggttcgagggcggagtgctggaggccgattgggcggcggtccgggagttgtcgcgggaggcggacaccaccgcctaccgggtggccgtggaggccttgacgaacgtacgccggcacgcgcccggggcggcgctcgtacgggtgggcctgcggcgggtcgctgaggggatcgagctgagcgtggccaactccgcgccgccccggggcggcgcgggcggacggctggggctggggctgcggcgacggggcggaaccgggctggccggtctgcgcggccgggtggaggcagcgggcgggacactgggggccggcgcgagtgccgacggcgggtggcgggtttgcgccgtcttcccggcgcgggaggacgccctcgggtgatcattgcggcgtgaccacacgcatcctgatagccgatgaccaagaggacatccgcagcggtttccggctgatcctcgattcgcagccggacatgaccgtggtgggggaggccgcggacggcgagagcgcggtgaccctggcccgggaactgcggcccgatgtggtgctggcggacatccggatgccgcggctcgacgggctggaggtgacgcggctgctggcgccgacgacgcgcgtggtggtggtgaccaccttcgacctggacgagtacgtgcacaccgcgttgcgcaacggcgcctgcggcttcctgctgaagcggtccgggccggcgctgctgatcgaaggggtgcgggcggcgatggcgggtgacaccctgatcagcccccagatcacggtgcggctgctcagccggctgacgcagtcgggtccggtcgcccggcccgcggcgcatccgctgacggagcgggaggtggacatcgtgcgcctggtggcgcgagggctcaccaacgccgagatcggcgcggagctgtacatcaccgcggggacggccaagacccacatcgcgaacgtccaggccaagctgggggcccgcaaccgggtgggaatcgccgcctgggcctgggagcacggtctcgccacagcggagccggaggcggacaccccctagatccccgtcatgtttcacgtgaaacgacgttgcgggtgagcggccaggcgagcaggccgacggagagcgcgatggcgtgtccgaggtcggtgaaggtaccgccggtgaccagggggatcccgaagaaggcgaccgctcccgccaggtagaaccatttccaggggccggggagccggtaggtgaggacaccgatggaggccgcgagcccgtagctgacgccgatgtcgaccacgtgggtcatgctgtgcggggcccggtggtcctggatggccgtcagcaggatcttctggctgatcaaggtggcgacgatgtgggcggtcgcgacgatcaggagccagcgcagggtgccgagccagcgttcgacgggggcgtggaacagctcgaagagcaccacgtagagggcgagcgaggccgggtccgcgatccagaacgcactgctgacgagtgcccggacggggtatttgacgagctggttgatgttgctgctgttgcggtggagcaggacgctgtcgacccggtcgggggcgatcgcgacgatgatgctggtgacggcgatgatcagcagccagacgtgcgttccgggcgaggagcgtatccaggaccgcaagggcctggaaggctccggctcggtgtgcgcgaccatgcaccgatgatgccgcgcgaacctgtgccccgcctggccggtgggccgggcggggcacaggttcgcgggtgctgcggcgggagaccctactcctcgcccgccagggtgaggcggcggagcttctggcccgcgtagacggtggcgccgacggtgaccgcgcagagcaggatcacggcggtgggcaggccgacggtggcgtcgacgtacccgttcccggcgaccttctccgcgacggacagggcccactgctggacgctgagggtcttggctccggagaccaggctgccgaagagcgactcccagatcagcgcgtagaccaggccgaagacgaccgcgtgccggctgacggtgccgagcagcaggaacagcgcgctgtaggcgatcgaggccacgagggcggcgatcgtgtaggcgacggcgatctgctggccgttcccgttgaggatgaatccggcgatcagggtggggaccgcggagaagaccatggtgacggcgatcgccacggtcagcttggtcatgatgatcgtcggacgcttcaccggcttggcgagcaggtagacgatggagccgtcgtcgatctcgggcccgatggccccggtaccggcgatgacgccgatcagcggaaccatggtggcgagggcgaagcccccgaggaggtcggccgcgaccttgtcgtccacgccgacgaagccacggacgacgagggcgatgacgatcagcagggcgggcagcgcgaagaggatcagcgcgcggcgccggccgagcagggcccggtaggtgagccgggcaacggtgggttcgtacatgggtgccagctcctttcaggccgcgacgaggtaggagaagaccgactcgagggactcgtcggagggcgagaccgtcagcagccggatgccgtgttcccgggccacgcggggcagcagctcggtgaagcggccgaagtcgacggcctggatgcgcagcgcgccttccttcaggtcgacctcgatgccggcggtggaggggtcggcgatcagggccgcggcgaggacccggtcgtcggaggagcggatgaggtagcggtgcgggcggtccgtcatcaggcggcggatcttgcggaagtcgccggacgcggcgtgccggccggccacgaccacctcgatgtgcgaggcgagctgctcgacctcctccaggatgtgggaggagaacaggacggtgcgcccctcgtcgcccatgcgccgcagcaggtccatgagctgcatgcgctgacgcgggtccatgccgttgaacggctcgtcgaggagcagtacggacggctcgtggacgagggccgaggccatcttcacgcgctggcgcatgcccttggagtaggtggagatcttgcggtcctgggcgtactccatctcgacggtggcgagcgcccgccgggctgccgcgtcgtcgaggccgtggagttcggcgttggcgacgacgaactcccggccggtgaggaagtcgtacatggcctcgcgctcgggcacgacgccgacctgcttgtagacctgctcgttctgccagatcggtgcgccgtcgagggtgacggtgcccgtggagggggcgaggaagccgcccatcatgttgatgagcgtggacttgcccgcgccgttggggcccagcagcccggtgacacccgggccgatgcgcatggtcacgtcgttgacggcgacgacgttcccgaaccagcgggaagtgtggtcgatgtcgatgatggtcacagcccggccttccggtagcgggccatcagggcggcgtaggagccgacgatgaggccgaggacgacgagcaggtagacgactccgacaccggccgaggggccctcgccgccggggaaggcggagtccgcgtgcaggaacgcggtctgtacgccgtcgatgagggtgatcggggagaacaggcccatccactcgatggccccggtgttgccggtgctgtaggcgatgccctggaccgcggtcaccgcgccgaaggggatcagcagcaccgcgatgatggcggcgacaccgaacccgcggcgcggggtgagggccgccatcaccaggccgaggcccgagaagagcagcgacagcagcagaaccgacacgagtccctgcccgaatcccttgatctggtgggagaagtcgaacttcgccagcatcgagccgatccacatgatcagcagcggggtggcggtgaggatgaacagggccgaggccatggccgcgtacttggccacgacgtagtcgacgcgctcgatgggccgcgagaagtagagcggcaccgtcttgaagcgcaggtcccgcgagacggactgcggggcctgggacgccaggtagaggtagacgatcacctgggtggtcacggcgtacgtcgtgtacttgatcggcaggtcggtgtagccgggcaccgcgatggcgaccgcgacgataatcagcgcgggcacgcacatcaccgcgaagaggatcatcgggaggaccttggacttggcggagcggccgagtccgtaggcgccgcgcagggactgcgagaacagtgacgtgcgggcgtaggcgcggccgagccggggtccgtcgtaggaccggtagccgatgttgtggatctgggtcgaggtgtcaggcgccatcggaaccggctcccttctgctggacggtgggcgagggctggtcgttgtcgcggaagacctccgcgatgtggtgacggcgctgctccatgcggaccaggccgatgcccaggtcggcgacggtgtcgcggacggtgtcgtacgtctcctcgccggtcgcctcgacgaggaggatgtggcccgctccgggcaggccctgctcctcgccggcgtgcagggtgacgccggcctcggtgagcgccttgcgcagggcggcggtgccgtccgggtgggtgtcggagtcggtgacctcgaccgcgagggtcgtggtgatctgggtgaagtcgctggtggagctggagcgcagcagcttgccgccgtcgacgacgaccacgtggtcgcaggtccgctccagctcgccgaggaggtgagaggtgaccaggacggagatgccgaagtcggtgtggatccggcggatcaggccgagcatctcgtcgcggccgaccgggtccagaccgttggtcggctcgtcgaggagcaccagctgggggtcgtggacgagggcctgggcgagcttgacgcgctgcttcatgccggtggagtagccgccgatgggacggtagcgctcctcgtacagtccgacgtggcgcagggtgtcggcggtgcgctcgcgggccgcggtcggcggcagcccggacatgcgcgccatgtggacgacgaactcggtggccgagacgtcgggcggcaggcagtcgtgctcgggcatgtagccgacgcgttcacggatggcgctgccatgcgtgcggacgtcgaggccgagcacggcggcgctgccctcggtggcgggggacagtcccagcagaattttgatcagcgtggacttgccggctccgttggcaccaacgaggccggtcacaccaggcccgatgtccagggagagccggtcgagggcggtcactcgggggtaccgcttgctcaggctttcggtcgcgatgacagtcacgggttcgacgttagtggcgcgtctcgcgcgagacgtcagacctggagctggatcccgtctcagccttcaggcgtacatacccgtactggaggctgatgcggacccgacaagtttgtccacaggtacgtgcacgactcttgacgtgatctccagtcattgtcacattcatcagtgtcaacttacgggcgcgtacggctacacggatggacgggctgagatggctggggacaccaagcaacgcaccgcgcgactctccgggcgacgctccgccgaactgagcggcttcagagaggtgcagcgcctctcctacgagtgcgccgaggccgtcgcggcccagctgcggcccggggtgaccgagcgcgaggccgcgcggatgcagcgcgagtggctgcgggagcgcggggtgcgggactggttccacctgcccttcgcctggttcggggaccgcaccgccttcgcgaacttcaggatcccgctgcagttcttcccgaccaatcggaagctggagccggggatgccgttcatcctcgacatggcaccggtctacaagggctacgcggccgacatcggctactcgggcagcctcgggctcaatccggtgcaggaccggctcatgtccgatctccaggcgcaccgcgagctgatcctggagcaggtgcgcgagcggcgctccctgcgcgagatctacgagaacgtcgaacggctgatgacccggcaggggtacgccaaccggcaccgggcctatcccttcggcgtgatcgcgcacaagatcgaccgggtgaaggagcgacgctggtcgccgaccgccttcggattcggcacccagtccctcaagggactggtcagcgacgccctgcacgggcaccgcgagggctggtccccgctgtggagcccgtaccacttctccgaccatccgccgcagcccggcctgtgggcggtggaaccgcacctcggattccggggcaccggcgcgaagttcgaggagatcctggtcgtcaccgactcccgggaccccgaggagagcgcgttctggctggacgacgatctgccgcacgtgcggcgctgggccgaggagaaggcagcatgagcgacatgggcggagcggaagcggtgggtctggcgggtgcgcgcgagcgccgggtgagcaccggtgggatcgagctgtgcgtggtcgagctcggcgagacgggccgaccgaccgtactgctggtgcacggctacccggacagcaaggaggtctggtcggaggtcgccgagcggctcgcgacccgcttccacgtggtgctctacgacgtacgcggccacgggcgctccaccgcgccgcagccgctgcgcggcggcttcaccctggagaagctgaccgacgacttcctggcggtggcggacgcggtcagcccggaccggcccgtccacctggtcggccacgactggggctccgtacagggctgggagttcgccacggtcgcccgcaccgagggcaggatcgcctccttcacctcgctgtcggggccctccctcgaccacttcggccactggatcaagaagcggatgacgcggcccaccccgcggggtgcggcacaactcctcggccagggcgccaagtcctggtacgtctacatgctgcacaccccggtgctgccggagctcgcctggcgcggaccgctcggcaagcggtggcccgcgatgctccagcgcatcgagaaggtgccggccggctcctatccgacggcctcactgccttcggacgcggcgcacggcgcctggctctaccgcgacaacgtacggccgcgactgcgccggccgcgccccgacgcgtacgcccacgtgcccgtacagctgatcaccccgaccggggacgccttcctgtcggagcggctctacgacggtctggagcgctgggccccggacctgctgcggcggaccctgcccgccaagcactgggtgccgcggacccggcccgaccagctggccgcctggatcacggagttcgtcaccgaccgggaggagcccgcgacgagggcaccggagcagaaggccccgggcaggtacgccgaccgcttcgcgggccagctggtcctggtcaccggcgcggccagcggcatcggccgggccaccgccttcgccttcgccgaggccggggcccgggtggtcgccgtggaccgcgacgcggaaggcgcggcgcgcacggccgacatggcccgtctcgtcggcgccgccgaggcctgggcggagtgcgtggacgtcagtgacgagcaggcgatggagaagctcgcggcgaaggtcgccgccgagtacggagtggtcgacgtcctggtcaacaatgccgggatcggcctgtccggcgccttcctcgacaccagcgccgaggactggaagaaggtcctggacgtcaacctctggggcgtcatccacggctgccggatcttcgggaagcagatggccgagcgcggccagggcgggcacatcgtcaacaccgcctccgccgccgcctacctgccgtccaggaccctgcccgcctacagcacctcgaaggccgcggtgctgatgctgtcggagtgcctgcgcgcggaactggcctcgaagtcgatcggcgtctccgcgatctgcccgggcatcgtcaacaccaacatcaccgccacctcgcgcttcgccggggtggacgaggccgaggagaagcgccgccaggaacgctcctcgcggctgtacgggctgcg
